(12) United States Patent
Bridgeman et al.

(10) Patent No.: US 11,945,876 B2
(45) Date of Patent: Apr. 2, 2024

(54) RECEPTORS PROVIDING TARGETED COSTIMULATION FOR ADOPTIVE CELL THERAPY

(71) Applicants: INSTIL BIO (UK) LIMITED, Manchester (GB); Instil Bio, Inc., Dallas, TX (US)

(72) Inventors: John Bridgeman, Manchester (GB); Robert Hawkins, Manchester (GB); Ruben Rodriguez, Dallas, TX (US); Gray Kueberuwa, Manchester (GB); Milena Kalaitsidou, Manchester (GB)

(73) Assignees: Instil Bio (UK) Limited, Manchester (GB); Instil Bio, Inc., Dallas, TX (US)

( * ) Notice: Subject to any disclaimer, the term of this patent is extended or adjusted under 35 U.S.C. 154(b) by 0 days.

(21) Appl. No.: 17/807,109

(22) Filed: Jun. 15, 2022

(65) Prior Publication Data

US 2023/0002504 A1    Jan. 5, 2023

Related U.S. Application Data

(60) Provisional application No. 63/301,340, filed on Jan. 20, 2022, provisional application No. 63/222,913, filed on Jul. 16, 2021, provisional application No. 63/211,046, filed on Jun. 16, 2021, provisional application No. 63/211,042, filed on Jun. 16, 2021.

(51) Int. Cl.

| | |
|---|---|
| *C07K 16/30* | (2006.01) |
| *A61K 35/17* | (2015.01) |
| *A61K 38/00* | (2006.01) |
| *A61K 39/00* | (2006.01) |
| *A61P 35/00* | (2006.01) |
| *C07K 14/705* | (2006.01) |

(52) U.S. Cl.
CPC .......... *C07K 16/3007* (2013.01); *A61K 35/17* (2013.01); *A61P 35/00* (2018.01); *C07K 14/70521* (2013.01); *C07K 14/70578* (2013.01); *A61K 38/00* (2013.01); *A61K 2039/505* (2013.01); *C07K 2317/565* (2013.01); *C07K 2317/622* (2013.01); *C07K 2317/76* (2013.01); *C07K 2319/02* (2013.01); *C07K 2319/33* (2013.01)

(58) Field of Classification Search
CPC .......... C07K 16/3007; C07K 14/70578; C07K 2317/565; C07K 2317/622; A61K 2039/505
See application file for complete search history.

(56) References Cited

U.S. PATENT DOCUMENTS

| | | |
|---|---|---|
| 5,399,346 A | 3/1995 | Anderson et al. |
| 5,580,859 A | 12/1996 | Felgner et al. |
| 5,589,466 A | 12/1996 | Felgner et al. |
| 5,858,358 A | 1/1999 | June et al. |
| 5,872,215 A | 2/1999 | Osbourne et al. |
| 5,876,691 A | 3/1999 | Chester et al. |
| 5,883,223 A | 3/1999 | Gray |
| 6,326,193 B1 | 12/2001 | Liu et al. |
| 6,352,694 B1 | 3/2002 | June et al. |
| 6,534,055 B1 | 3/2003 | June et al. |
| 6,692,964 B1 | 2/2004 | June et al. |
| 6,797,514 B2 | 9/2004 | Berenson et al. |
| 6,867,041 B2 | 3/2005 | Berenson et al. |
| 6,887,466 B2 | 5/2005 | June et al. |
| 6,905,680 B2 | 6/2005 | June et al. |
| 6,905,681 B1 | 6/2005 | June et al. |
| 6,905,874 B2 | 6/2005 | Berenson et al. |
| 7,067,318 B2 | 6/2006 | June et al. |
| 7,144,575 B2 | 12/2006 | June et al. |
| 7,172,869 B2 | 2/2007 | June et al. |
| 7,175,843 B2 | 2/2007 | June et al. |
| 7,232,566 B2 | 6/2007 | June et al. |
| 7,232,888 B2 | 6/2007 | Begent et al. |
| 7,273,608 B2 | 9/2007 | Yazaki et al. |
| 7,446,190 B2 | 11/2008 | Sadelain et al. |
| 7,507,412 B2 * | 3/2009 | Burger ............. C07K 14/70503 530/387.3 |
| 7,626,011 B2 | 12/2009 | Begent et al. |
| 7,741,465 B1 | 6/2010 | Eshhar et al. |

(Continued)

FOREIGN PATENT DOCUMENTS

| | | |
|---|---|---|
| AU | 723073 B2 | 8/1998 |
| AU | 2010230063 B2 | 9/2010 |

(Continued)

OTHER PUBLICATIONS

Lee et al. A mechanical switch couples T cell receptor triggering to the cytoplasmic juxtamembrane regions of CD3ζζImmunity. Aug. 18, 2015; 43(2): 227-239. doi:10.1016 (Year: 2015).*
Lee Supplemental (Year: 2015).*
Gilham et al. Primary Polyclonal Human T Lymphocytes Targeted to Carcino-Embryonic Antigens and Neural Cell Adhesion Molecule Tumor Antigens by CD3-Based Chimeric Immune Receptors Journal of Immunotherapy, 25(2):139-151 2002 (Year: 2002).*
Ahonen et al., The CD40-TRAF6 Axis Controls Affinity Maturation and the Generation of Long-lived Plasma Cells. Nat Immunol. May 2002;3(5): 451-456.
Altschul et al., Basic local alignment search tool. J Mol Biol. Oct. 5, 1990; 215(3): 405-410.

(Continued)

*Primary Examiner* — Amy E Juedes
*Assistant Examiner* — Brian Hartnett
(74) *Attorney, Agent, or Firm* — KNOBBE, MARTENS, OLSON & BEAR, LLP

(57) ABSTRACT

Some embodiments provided herein are chimeric costimulatory antigen receptor (CoStAR), useful in adoptive cell therapy (ACT), and cells comprising the CoStAR. In some embodiments, the CoStAR can act as a modulator of cellular activity enhancing responses to defined antigens. In some embodiments, CoStAR and/or fusion proteins, nucleic acids encoding the CoStAR and therapeutic uses thereof are also provided.

14 Claims, 100 Drawing Sheets

Specification includes a Sequence Listing.

(56) References Cited

U.S. PATENT DOCUMENTS

| | | | |
|---|---|---|---|
| 8,357,783 B2 | 1/2013 | Dimitrov et al. | |
| 9,272,002 B2 | 3/2016 | Powell, Jr. et al. | |
| 9,359,447 B2 | 6/2016 | Feldman et al. | |
| 9,409,992 B2 | 8/2016 | Ho et al. | |
| 9,598,489 B2 | 3/2017 | Powell, Jr. | |
| 10,117,896 B2 | 11/2018 | Powell, Jr. et al. | |
| 10,640,569 B2 | 5/2020 | Beatty et al. | |
| 10,654,928 B2 | 5/2020 | Kloss et al. | |
| 10,844,117 B2 | 11/2020 | Powell, Jr. | |
| 10,881,688 B2 | 1/2021 | Leek et al. | |
| 10,981,969 B2 | 4/2021 | June et al. | |
| 2004/0043401 A1* | 3/2004 | Sadelain | C07K 14/70521 435/325 |
| 2004/0101519 A1 | 5/2004 | June et al. | |
| 2005/0147614 A1* | 7/2005 | Begent | C07K 16/00 424/155.1 |
| 2006/0034810 A1 | 2/2006 | Riley et al. | |
| 2006/0121005 A1 | 6/2006 | Berenson et al. | |
| 2007/0036773 A1 | 2/2007 | Cooper et al. | |
| 2011/0142850 A1 | 6/2011 | Subauste | |
| 2012/0321667 A1 | 12/2012 | Sentman | |
| 2014/0050708 A1 | 2/2014 | Powell, Jr. et al. | |
| 2014/0099309 A1 | 4/2014 | Powell, Jr. et al. | |
| 2014/0286987 A1 | 9/2014 | Spencer et al. | |
| 2015/0031624 A1 | 1/2015 | Feldman et al. | |
| 2016/0311917 A1 | 10/2016 | Beatty et al. | |
| 2017/0209492 A1 | 7/2017 | June et al. | |
| 2017/0246278 A1 | 8/2017 | Valdes et al. | |
| 2018/0044404 A1 | 2/2018 | Oda et al. | |
| 2018/0125890 A1 | 5/2018 | Anderson et al. | |
| 2018/0273640 A1 | 9/2018 | Liang et al. | |
| 2018/0280437 A1 | 10/2018 | Wiltzius et al. | |
| 2018/0319862 A1* | 11/2018 | Thompson | A61P 35/00 |
| 2019/0023764 A1 | 1/2019 | Wu et al. | |
| 2020/0009190 A1 | 1/2020 | Oda et al. | |
| 2020/0078402 A1 | 3/2020 | Ostertag et al. | |
| 2020/0115448 A1 | 4/2020 | Liu et al. | |
| 2020/0281973 A1 | 9/2020 | Dranoff | |
| 2022/0160760 A1 | 5/2022 | Bridgeman et al. | |
| 2022/0348631 A1 | 11/2022 | Bridgeman et al. | |
| 2023/0002470 A1 | 1/2023 | Bridgeman et al. | |
| 2023/0055694 A1 | 2/2023 | Bridgeman et al. | |
| 2023/0059511 A1 | 2/2023 | Bridgeman et al. | |
| 2023/0227576 A1 | 7/2023 | Bridgeman et al. | |

FOREIGN PATENT DOCUMENTS

| | | |
|---|---|---|
| AU | 2018202446 B2 | 1/2018 |
| CA | 2931684 A1 | 6/2015 |
| WO | WO 1996/013584 A1 | 5/1996 |
| WO | WO 1996/023814 A1 | 8/1996 |
| WO | WO 2001/029058 | 4/2001 |
| WO | WO 2001/096584 | 12/2001 |
| WO | WO 2002/098458 A1 | 12/2002 |
| WO | WO 2005/086875 A2 | 9/2005 |
| WO | WO 2013/063419 A2 | 5/2013 |
| WO | WO 2015/112626 A9 | 7/2015 |
| WO | WO 2016/008973 A1 | 1/2016 |
| WO | WO 2016/141357 A1 | 9/2016 |
| WO | WO 2017/079705 A1 | 5/2017 |
| WO | WO 2017/176525 A1 | 10/2017 |
| WO | WO 2018/156711 A1 | 8/2018 |
| WO | WO 2018/208849 A1 | 11/2018 |
| WO | WO 2020/016661 A2 | 1/2020 |
| WO | WO 2020/152451 A1 | 7/2020 |
| WO | WO 2021/048850 A1 | 3/2021 |
| WO | WO 2022/150831 A1 | 7/2022 |

OTHER PUBLICATIONS

Ankri et al., Human T Cells Engineered to Express a Programmed Death 1/28 Costimulatory Retargeting Molecule Display Enhanced Antitumor Activity. J Immunol. Oct. 15, 2013;191(8): 4121-4129.

Barrangou et al., CRISPR provides acquired resistance against viruses in prokaryotes. Science. Mar. 23, 2007; 315(5819): 1709-1712.

Bosslet et al., "Generation of Bispecific Monoclonal Antibodies for Two Phase Radioimmunotherapy". Br J Cancer May 1991;63(5): 681-686.

Bergan et al., Development and In Vitro Validation of Anti-mesothelin Biobodies that Prevent CA125/Mesothelin-dependent Cell Attachment. Cancer Letts. Oct. 8, 2007;255(2): 263-274.

Bridgeman et al., Building Better Chimeric Antigen Receptors for Adoptive T Cell Therapy. Curr Gene Ther. Apr. 1, 2010; 10(2): 77-90.

Chester et al., Phage Libraries for Generation of Clinically Useful Antibodies. The Lancet. Feb. 19, 1994;343(8895): 455-456.

Chowdhury et al., Isolation of Anti-mesothelin Antibodies from a Phage Display Library. Mol immunol. Jan. 1, 1997;34(1): 9-20.

Chowdhury et al., Isolation of a High-affinity Stable Single-chain Fv Specific for Mesothelin from DNA-immunized Mice by Phage Display and Construction of a Recombinant Immunotoxin with Anti-tumor Activity. PNAS. Jan. 20, 1998;95(2): 669-674.

Chowdhury et al., Improving Antibody Affinity by Mimicking Somatic Hypermutation in vitro. Nature Biotech. Jun. 1999;17(6): 568-572.

Chung et al., All TRAFs are not Created Equal: Common and Distinct Molecular Mechanisms of TRAF-mediated Signal Transduction. J Cell Science Feb. 15, 2002; 115(4): 679-688.

ClinicalTrials.gov: NCT00968760; "CD19-specific T Cell Infusion in Patients with B-Lineage Lymphoid Malignancies". Aug. 31, 2009. NIH U.S. National Library of Medicine; downloaded in 10 pages.

ClinicalTrials.gov: NCT01653717; "CD19-specific T-cell for Chronic Lymphocytic Leukemia (CLL)". Jul. 31, 2021. NIH U.S. National Library of Medicine; downloaded in 7 pages.

Chothia et al., Canonical Structures for the Hypervariable Regions of Immunoglobulins. J Mol Biol. Aug. 20, 1987; 196(4): 901-917.

Chothia et al., Conformations of Immunoglobulin Hypervariable Regions. Nature Dec. 1989; 342(6252): 877-883.

Davis et al., T-cell Antigen Receptor Genes and T-cell Recognition. Nature Aug. 1, 1988; 334(6181):395-402.

Davis et al., Ligand Recognition by (alpha)(beta) T Cell Receptors. Annu Rev Immunol. (1998) 16: 523-544.

Feng et al., A Novel Human Monoclonal Antibody that Binds with High Affinity to Mesothelin-expressing Cells and Kills Them by Antibody-dependent Cell-mediated Cytotoxicity. Mol Cancer Ther. May 2009;8(5): 1113-1118.

GenBank accession No. NP_001241.1; provided by RefSeq Nov. 2014, 3 pages.

GenBank accession No. NP_001552.2; provided by RefSeq Jul. 2008, 3 pages.

GenBank accession No. NP_001758.2; provided by RefSeq Jun. 2016, 4 pages.

GenBank accession No. NP_003028.1; last updated Mar. 6, 2000, 3 pages.

GenBank accession No. NP_003318.1; provided by RefSeq Jul. 2008, 3 pages.

GenBank accession No. NP_004186.1; provided by RefSeq Feb. 2011, 3 pages.

GenBank accession No. NP_036224.1; provided by RefSeq Jul. 2008, 4 pages.

GenBank accession No. NP_055081.1; provided by RefSeq Jul. 2008, 3 pages.

GenBank accession No. NP_596867; provided by RefSeq Jul. 2008, 5 pages.

GenBank accession No. NP_001139345.1; provided by RefSeq May 2020, 3 pages.

GenBank accession No. NM_001291484.3; provided by RefSeq Jul. 2015, 7 pages.

GenBank accession No. NP_001315538.1; provided by RefSeq Jun. 2016, 3 pages.

GenBank accession No. NP_001317683.1; last updated Sep. 3, 2016, 3 pages.

(56) References Cited

OTHER PUBLICATIONS

Grissa et al., The CRISPRdb database and tools to display CRISPRs and to generate dictionaries of spacers and repeats. BMC Bioinformatics. May 23, 2007; 8(1): 172; 10 pages.
Grupp et al., Chimeric Antigen Receptor—Modified T Cells for Acute Lymphoid Leukemia. New Engl J Med. Apr. 18, 2013;368(16): 1509-1518.
Guedan et al., Enhancing CAR T Cell Persistence through ICOS and 3-1BB Costimulation. JCI Insight. Jan. 11, 2018; 3(1): e96976 in 17 pages.
Guest et al., The role of extracellular spacer regions in the optimal design of chimeric immune receptors: evaluation of four different scFvs and antigens. J Immunother. May 1, 2005; 28(3): 203-211.
Haanen et al., Selective Expansion of Cross-reactive CD8+ Memory T Cells by Viral Variants. J Exp Med., Nov. 1, 1999;190(9): 1319-1328.
Ho et al., A Novel High-Affinity Human Monoclonal Antibody to Mesothelin. Intl J Cancer. May 1, 2011;128(9): 2020-2030.
Hudecek et al., Receptor affinity and extracellular domain modifications affect tumor recognition by ROR1-specific chimeric antigen receptor T cells. Clin Cancer Res. Jun. 15, 2013; 19(12): 3153-3164.
Hudecek et al., The nonsignalling extracellular spacer domain of chimeric antigen receptors is decisive for in vivo antitumor activity. Cancer Immunol Res. Feb. 2015; 3(2): 125-135.
Hurton et al., Tethered IL-15 Augments Antitumor Activity and Promotes a Stem-cell Memory Aubset in Tumor-specific T Cells. PNAS USA. Nov. 29, 2016;113(48): E7788-E7797.
Huston et al., "Protein Engineering of Single-Chain Fv Analogs and Fusion Proteins". In Methods in Enzymology Jan. 1, 1991; 203: 46-88.
Izumoto et al., Phase II Clinical Trial of Wilms Tumor 1 Peptide Vaccination for Patients with Recurrent Glioblastoma Multiforme. J Neurosurg. 2008. 108(5): 963-971.
Jackson et al., "Antigen Specificity and Tumour Targeting Efficiency of a Human Carcinoembryonic Antigen-specific scFv and Affinity-matured Derivatives". Br J Cancer. Jul. 1998;78(2): 181-188.
Kabat E A, et al., Sequences of Proteins of Immunological Interest (National Institutes of Health, Bethesda, Md., 1991; TOC in 28 pages.
Kloss et al., Combinatorial antigen recognition with balanced signaling promotes selective tumor eradication by engineered T cells. Nat Biotechnol. Jan. 2013; 31(1): 71-75.
Kochenderfer et al., Chemotherapy-refractory diffuse large B-cell lymphoma and indolent B-cell malignancies can be effectively treated with autologous T cells expressing an anti-CD19 chimeric antigen receptor. J Clin Oncol. Feb. 20, 2015; 33(6): 540-550.
Kostelny et al., Formation of bispecific antibody by the use of leucine zippers. J Immunol. Mar. 1, 1992;148(5): 1547-1553.
Li et al., Limited Cross-Linking of 4-1BB by 4-1BB Ligand and the Agonist Monoclonal Antibody Utomilumab. Cell Reports 2018; 25:909-920.
Mackey et al., Distinct Contributions of Different CD40 TRAF Binding Sites to CD154-induced Dendritic Cell Maturation and IL-12 Secretion. Eur J Immunol. Mar. 2003; 33(3): 779-789.
Manuri et al., piggyBac Transposon/Transposase System to Generate CD19-specific T Cells for the Treatment of B-lineage Malignancies. Hum Gene Ther. Apr. 1, 2010;21(4): 427-437.
Marraffini et al., CRISPR Interference Limits Horizontal Gene Transfer in Staphylococci by Targeting DNA. Science Dec. 19, 2008;322(5909): 1843-1845.
Mátés et al., Molecular Evolution of a Novel Hyperactive Sleeping Beauty Transposase Enables Robust Stable Gene Transfer in Vertebrates. Nat Genet. Jun. 2009;41(6): 753-761.
Monjezi et al., Enhanced CAR T-cell engineering using non-viral Sleeping Beauty transposition from minicircle vectors. Leukemia. Jan. 2017;31(1): 186-194.
Morita et al., Enhanced Expression of Anti-CD19 Chimeric Antigen Receptor in piggyBac Transposon-engineered T Cells. Mol Ther Meth Clin Dev. Mar. 16, 2018;8: 131-140; online 2017.
Mukundan et al., TNF Receptor-associated Factor 6 is an Essential Mediator of CD40-activated Proinflammatory Pathways in Monocytes and Macrophages. J Immunol. Jan. 15, 2005; 174(2): 1081-1090.
Nakazawa et al, PiggyBac-mediated Cancer Immunotherapy Using EBV-specific Cytotoxic T-cells Expressing HER2-specific Chimeric Antigen Receptor. Mol Ther. Dec. 1, 2011;19(12): 2133-2143.
Osbourn et al., "Generation of a Panel of Related Human scFv Antibodies with High Affinities for Human CEA". Immunotech. Sep. 1, 1996; 2(3): 181-196.
Park H.H., Structure of TRAF Family: Current Understanding of Receptor Recognition. Front Immunol. Aug. 30, 2018; 9: 1999 in 7 pages.
Paul W., Ed., Non-specific Components. In Fundamental Immunology, 2nd ed. Raven Press, N.Y., 1989, Ch. 7; 7 pages.
Pearson et al., Improved tools for biological sequence comparison. PNAS USA Apr. 1988; 85(8): 2444-2448.
Prosser et al., Tumor PD-L1 Co-stimulates Primary Human CD8+ Cytotoxic T Cells Modified to Express a PD1: CD28 Chimeric Receptor. Mol Immunol.. Jul. 1, 2012;51(3-4): 263-272.
Rapoport et al., NY-ESO-1 Specific TCR Engineered T-cells Mediate Sustained Antigen-specific Antitumor Effects in Myeloma. Nat Med. Aug. 2015;21(8): 914-921.
Rosenberg et al., Use of Tumor-Infiltrating Lymphocytes and Interleukin-2 in the Immunotherapy of Patients with Metastatic Melanoma. New England J Med. Dec. 22, 1988;319(25): 1676-1680.
Rosenberg et al., Gene Transfer Into Humans—Immunotherapy of Patients with Advanced Melanoma, Using Tumor-infiltrating Lymphocytes Modified by Retroviral Gene Transduction. New England J Med. Aug. 30, 1990;323(9): 570-578.
Sambrook et al., Molecular Cloning: A Laboratory Manual. Cold Spring Harbor Laboratory, New York; 2001, TOC; 18 pages.
Schmidt et al., "Kinetics of Anti-carcinoembryonic Antigen Antibody Internalization: Effects of Affinity, Bivalency, and Stability". Cancer Immunol Immunother. Dec. 2008;57(12): 1879-1890.
Scholler et al., Decade-long Safety and Function of Retroviral-modified Chimeric Antigen Receptor T Cells. Sci Transl Med. May 2, 2012;4(132): 132ra53; in 16 pages.
Singh et al., Redirecting Specificity of T-cell Populations for CD19 Using the Sleeping Beauty System. Cancer Res. Apr. 15, 2008;68(8): 2961-2971.
Songsivilai et al., Bispecific Antibody: A Tool for Diagnosis and Treatment of Disease. Clin Exp Immunol. Mar. 1990;79(3): 315-321.
Ten Berge et al., Selective Expansion of a Peripheral Blood CD8+ Memory T cell Subset Expressing Both Granzyme B and L-selectin During Primary Viral Infection in Renal Allograft Recipients. Transplant Proc. Dec. 1, 1998;30(8): 3975-3977.
Thokala et al., Redirecting Specificity of T Cells Using the Sleeping Beauty System to Express Chimeric Antigen Receptors by Mix-and-Matching of VL and VH Domains Targeting CD123+ Tumors. PLoS One. Aug. 22, 2016;11(8): e0159477 in 23 pages.
UniProtKB/Swiss-Prot: Accession No. P01861; "Nucleotide Sequence of a human immunoglobulin C gamma 4 gene". Dated: Jul. 21, 1986; Downloaded in 7 pages.
Van der Schans et al., Dual Targeting to Overcome Current Challenges in Multiple Myeloma CAR T-cell Treatment. Front Oncol. Aug. 5, 2020;10: 1362 in 8 pages.
Wilkie et al., Retargeting of human T cells to tumor-associated MUC1: the evaluation of a chimeric antigen receptor. J Immunol. Apr. 1, 2008; 180(7): 4901-4909.
Yazaki et al., "Inhibition by Rho-kinase and Protein Kinase C of Myosin Phosphatase is Involved in Thrombin-induced Shape Change of Megakaryocytic Leukemia Cell Line UT-7/TPO". Cell Signal. Mar. 1, 2005;17(3): 321-330.
Ye et al., The Structural Basis for the Recognition of Diverse Receptor Sequences by TRAF2. Mol Cell. Sep. 1999; 4: 321-330.
Zhang et al., Humanization of Rabbit Monoclonal Antibodies via Grafting Combined Kabat/IMGT/Paratome Complementarity-determining Regions: Rationale and Examples. InMAbs Apr. 3, 2017;9(3):419-429.

(56) References Cited

OTHER PUBLICATIONS

Alvarez-Vallina et al., Antigen-Specific Targeting of CD28-Mediated T Cell Co-Stimulation Using Chimeric Single-Chain Antibody Variable Fragment-CD28 Receptors. Euro J Immunol. Oct. 1, 1996; 26(10):2304-2309.

Lanitis et al., Chimeric Antigen Receptor T Cells with Dissociated Signaling Domains Exhibit Focused Antitumor Activity with Reduced Potential for Toxicity In Vivo. Cancer Immun Res. Jul. 1, 2013; 1(1): 43-53.

Li et al., Chimeric Antigen Receptor-Engineered T Cells for Liver Cancers, Progress and Obstacles. Tumor Biol. Mar. 2017; 39(3): 1-8.

Levin-Piaeda O., CD40 Costimulation Enhances CAR-T Cell Activation—Joint Meeting of the Israeli Immunol. Society (IIS) and Israeli Society for Cancer Research (ISCR) 2019; pp. 1-2 (Sep. 25, 2019) Retrieved from the Internet: URL: https://program.eventact.com/lecture?id=204321&code=430912; 1 page.

Mata et al., Inducible Activation of MyD88 and CD40 in CAR T Cells Results in Controllable and Potent Antitumor Activity in Preclinical Solid Tumor. Cancer Disc. Nov. 1, 2017; 7(11): 1306-1319.

Weinkove et al., Selecting Costimulatory Domains for Chimeric Antigen Receptors: Functional and Clinical Considerations. Clin Transl Immunol. Jan. 1, 2019; 8(5): e1049.

International Search Report and Written Opinion issued in PCT/GB2020/050120 dated Apr. 7, 2020; 11 pages.

International Search Report and Written Opinion issued in PCT/US2021/042075 dated Oct. 27, 2021; 12 pages.

International Search Report and Written Opinion issued in PCT/US2021/042079 dated Oct. 28, 2021; 12 pages.

International Search Report and Written Opinion issued in PCT/US2022/073741 dated Nov. 22, 2022; 12 pages.

U.S. Appl. No. 17/562,618, including its patent prosecution history, the cited references, and the Office Actions therein, filed Dec. 27, 2021, Bridgeman et al.

U.S. Appl. No. 17/823,223, including its patent prosecution history, the cited references, and the Office Actions therein, filed Aug. 30, 2022, Bridgeman et al.

U.S. Appl. No. 17/822,251, including its patent prosecution history, the cited references, and the Office Actions therein, filed Aug. 25, 2022, Bridgeman et al.

U.S. Appl. No. 17/936,102, including its patent prosecution history, the cited references, and the Office Actions therein, filed Sep. 28, 2022, Bridgeman et al.

ClinicalTrials.gov: NCT01653717; "CD19-specific T-cell for Chronic Lumphocytic Leukemia (CLL)". NIH U.S. National Library of Medicine; Jul. 31, 2012; downloaded in 7 pages.

International Search Report and Written Opinion issued in PCT/US2022/033580 dated Nov. 7, 2022; 14 pages.

Yu et al., Reducing affinity as a strategy to boost immunomodulatory antibody agonism. Nature. Feb. 2023;1:1-9.

U.S. Office Action dated Dec. 27, 2022 for U.S. Appl. No. 17/936,102.

U.S. Appl. No. 18/157,027, including its patent prosecution history, the cited references, and the Office Actions therein, filed Jan. 19, 2023, Bridgeman et al.

Finney et al., Chimeric Receptors Providing Both Primary and Costimulatory Signaling in T Cells from a Single Gene Product. J Immunol. Sep. 15, 1998;161(6): 2791-2797.

Fisher et al., Engineering γδT cells limits tonic signaling associated with chimeric antigen receptors. Sci Signal. Sep. 10, 2019; 12(598): eaax1872 in 34 pages.

Garland et al., The Use of Teflon Cell Culture Bags to Expand Functionally Active CD8+ cytotoxic T Lymphocytes. J Immunol Meth. Jul. 30, 1999;227(1-2): 53-63.

Govers et al., "TCRs Genetically Linked to CD28 and CD3ε do not mispair with endogenous TCR chains and mediate enhanced T cell persistence and anti-melanoma activity". J Immunol. Nov. 15, 2014;193(10): 5315-26.

Maher et al., Human T-lymphocyte Cytotoxicity and Proliferation directed by a Single Chimeric TCRζ/CD28 Receptor. Nature Biotech. Jan. 1, 2002;20(1): 70-75.

Morgan et al., "Cancer Regression in Patients After Transfer of Genetically Engineered Lymphocytes". Science Oct. 6, 2006;314(5796): 126-129.

Murphy K. Janeway's Immunobiology. (2011) x-xix, TOC in 12 pages.

Rosenberg S.A., Cell transfer immunotherapy for metastatic solid cancer—what clinicians need to know. Nat Rev Clin Oncol. Aug. 2, 2011;8(10): 577-585.

U.S. Office Action dated Mar. 30, 2023 for U.S. Appl. No. 17/936,102.

U.S. Appl. No. 18/316,548, including its patent prosecution history, the cited references, and the Office Actions therein, filed May 12, 2023, Bridgeman et al.

U.S. Appl. No. 18/323,342, including its patent prosecution history, the cited references, and the Office Actions therein, filed May 24, 2023, Moon et al.

ClinicalTrials.gov: NCT03585764; "MOv19-BBz CAR T Cells in aFR Expressing Recurrent High Grade Serous Ovarian, Fallopian Tube, or Primary Peritoneal Cancer". NIH U.S. National Library of Medicine; Jul. 13, 2018; downloaded in 9 pages.

Foster et al., Regulated Expansion and Survival of Chimeric Antigen Receptor-modified T Cells Using Small Molecule-dependent Inducible MyD88/CD40. Mol Ther. Sep. 6, 2017;25(9): 2176-2188.

Kanda et al., Construction and expression of chimeric antibodies by a simple replacement of heavy and light chain V genes into a single cassette vector. Hybridoma Oct. 1994;13(5): 359-366.

Kandalaft et al., A Phase I Clinical Trial of Adoptive Transfer of Folate Receptor-α Redirected Autologous T Cells for Recurrent Ovarian Cancer. J Transl Med. Dec. 2012;10: 157; in 10 pages.

Lim et al., The Principles of Engineering Immune Cells to Treat Cancer. Cell. Feb. 9, 2017;168(4): 724-740.

Munroe et al., A Costimulatory Function for T Cell CD40. J Immunol. Jan. 15, 2007;178(2): 671-682.

International Search Report and Written Opinion issued in PCT/US2023/060937 dated Jul. 27, 2023; 14 pages.

Office Action issued in U.S. Appl. No. 17/936,102 dated Dec. 12, 2023; 19 pages.

2023-12-05_07-05-38. Sequence Alignments. (Year: 2023).

\* cited by examiner

6A.

6B.

6C.

6D.

35A.

35B.

37A.
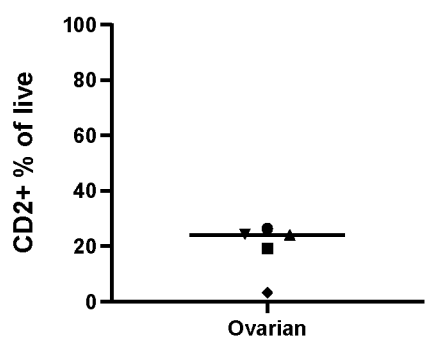
37B.
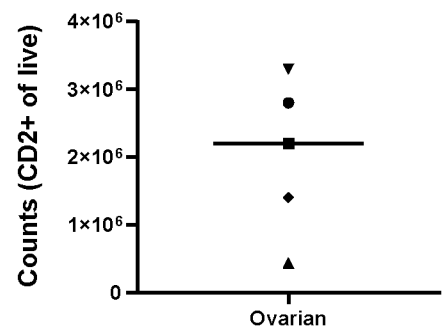
Fig. 37A-B
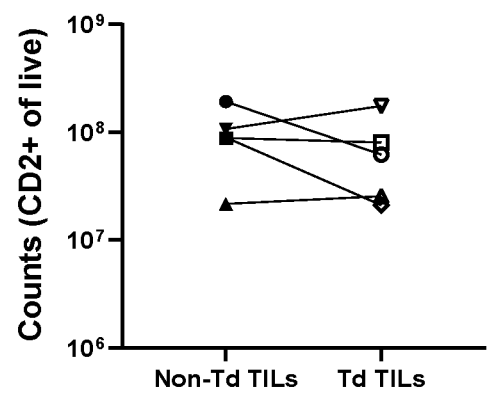
Fig. 38

39A. 
39B. 
39C. 
39D.

41A.

41B.

41C.

42A.

42B.

43A.

43B.

44A.

44B.

44C.

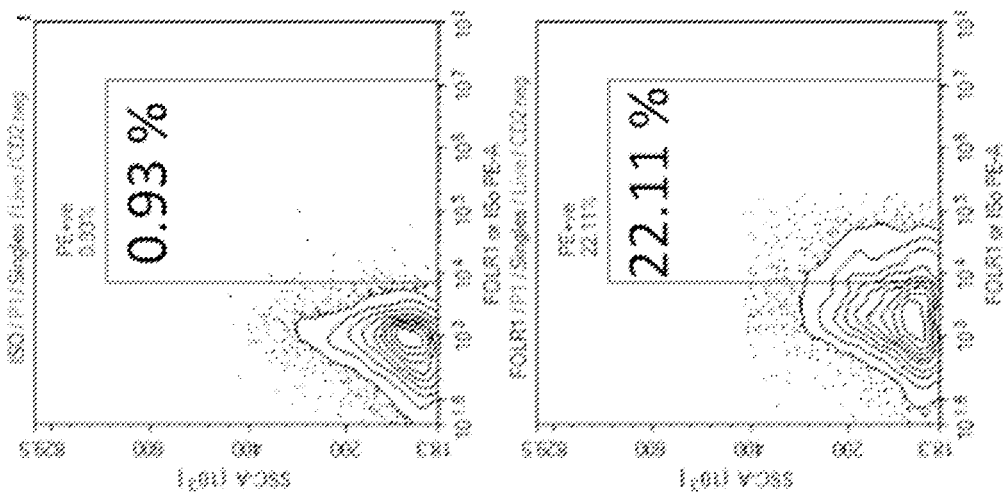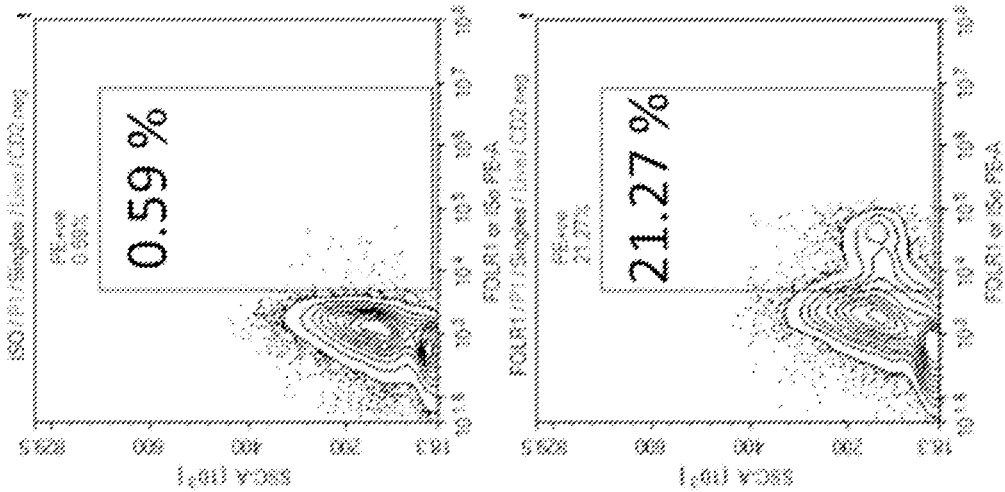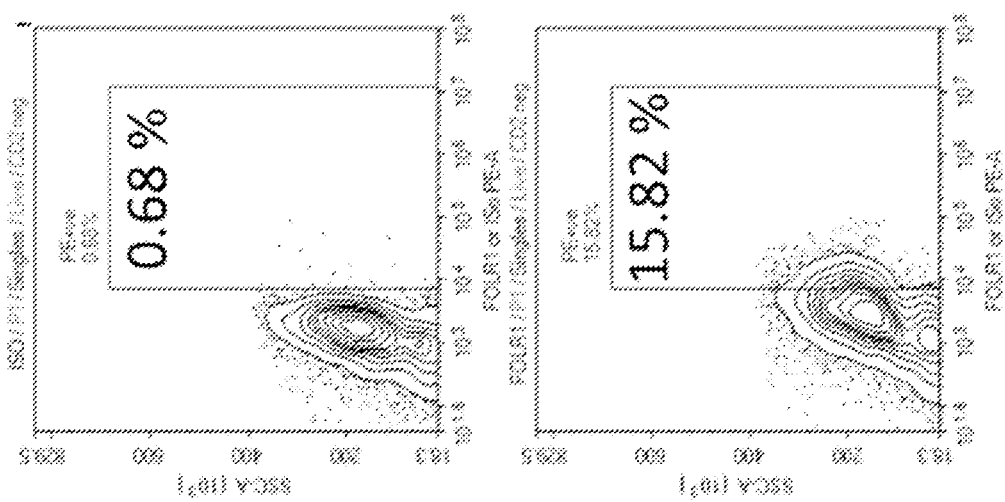
Fig. 45

47A.

47B.

47C.

47D.

46E.

49A.
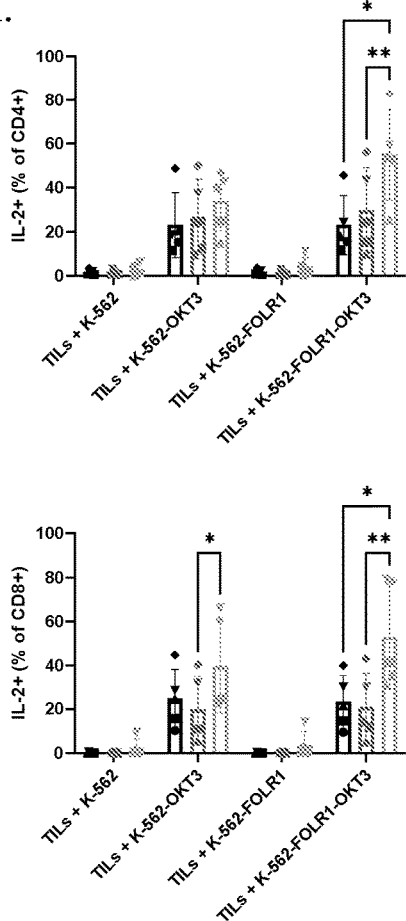
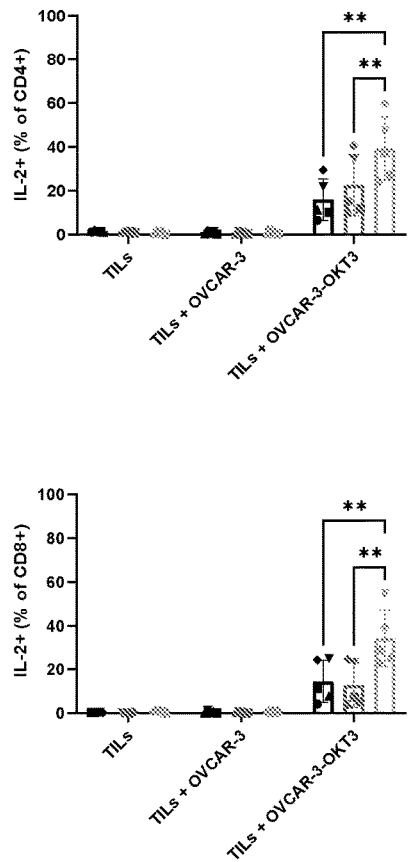
■ ● ▼ ▲ ◆ Non-Td TILs    Anti-FOLR1 CoStAR- Td TILs    Anti-FOLR1 CoStAR+ Td TILs
Fig. 49A

51A.

51B.

51C.

61A.
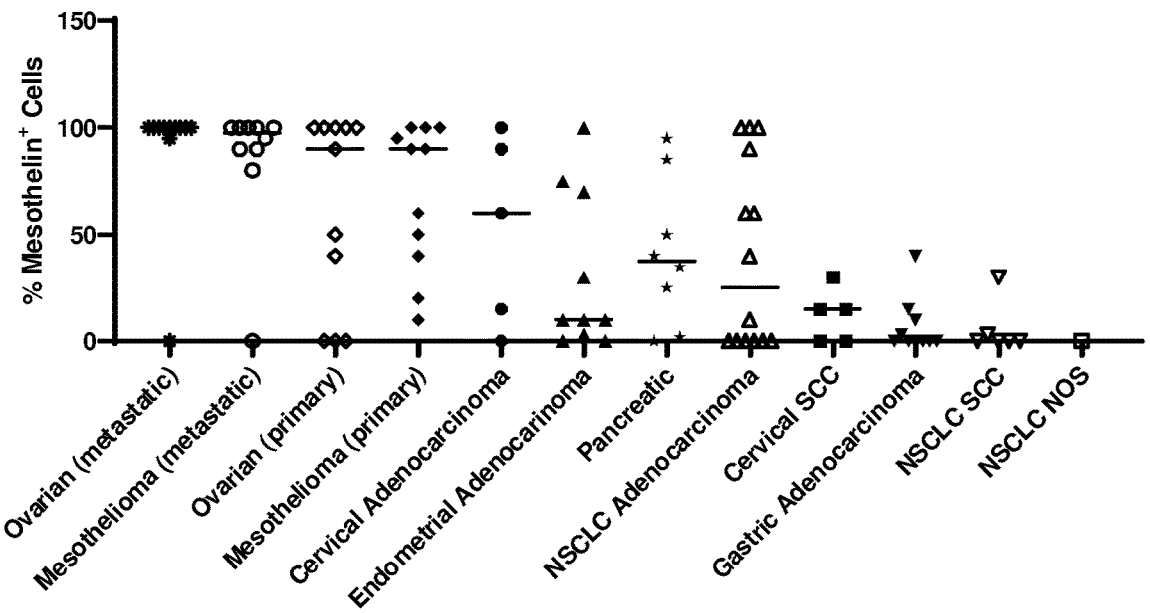
61B.
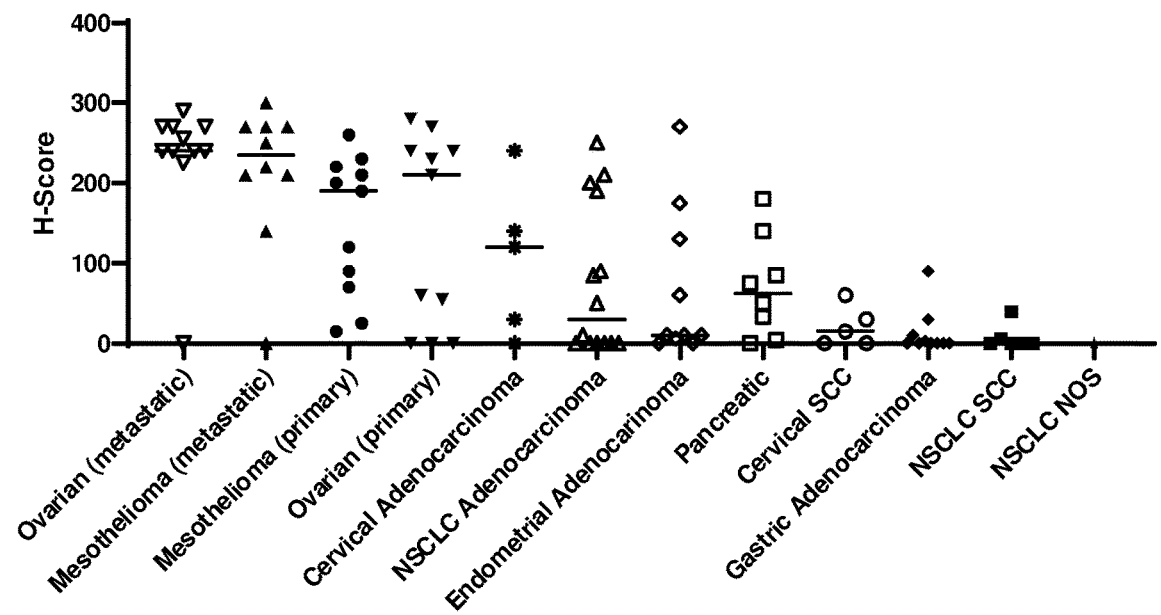
FIG. 61A-B

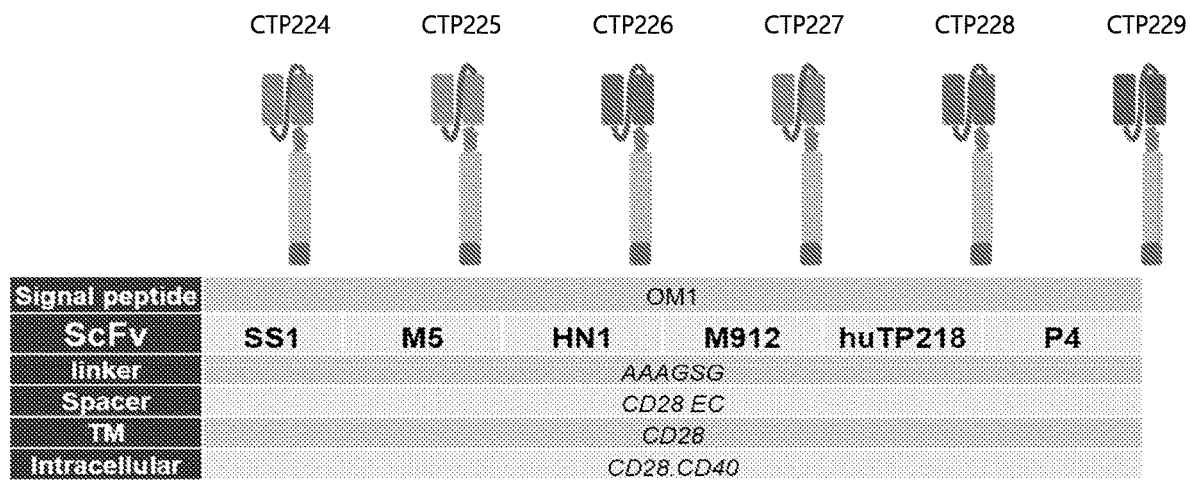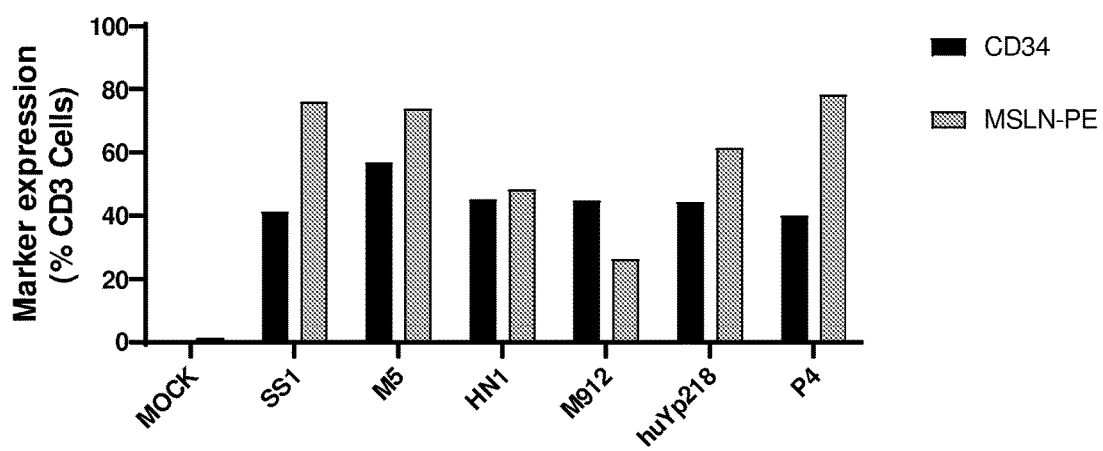
FIG. 62

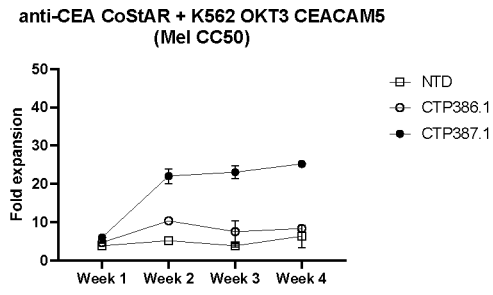
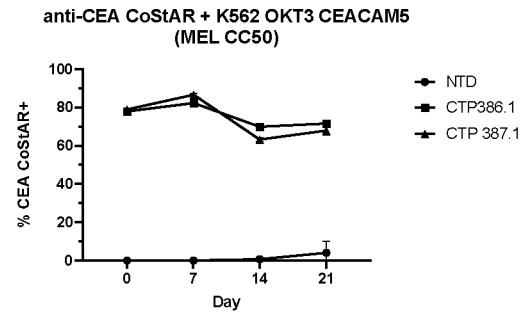
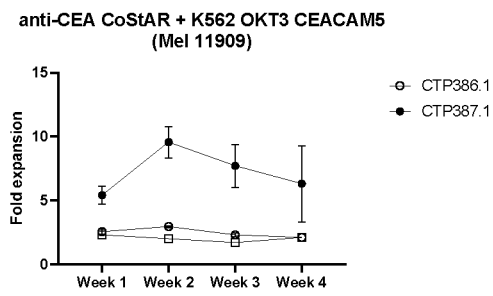
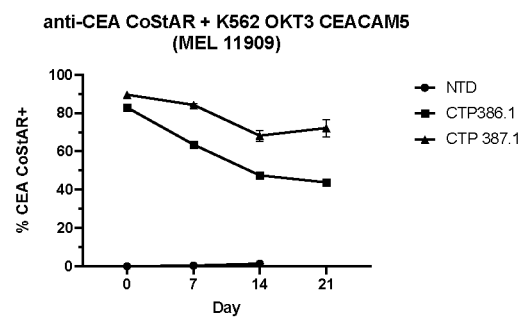
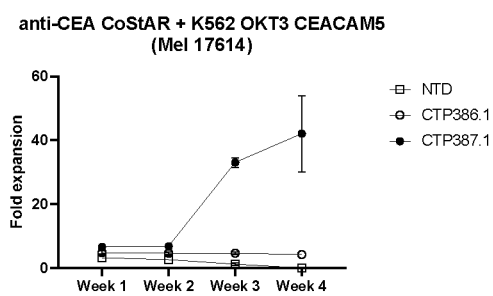
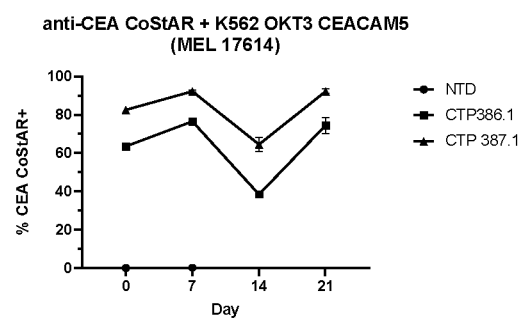
FIG. 82

CoStAR CEA.ICOS.CD40 SEQ ID NO: 348
Full sequence:
MGVLLTQRTLLSLVLALLFPSMASMQVKLEQSGAEVVKPGASVKLSCKAS<u>GFNIKDSY</u>
MHWLRQGPGQRLEWIGWI<u>DPENGD</u>TEYAPKFQGKATFTTDTSANTAYLGLSSLRPEDT
AVYYCNEG<u>TPTGPYYFD</u>YWGQGTLVTVSSGGGGSGGGGSGGGGSENVLTQSPSSMSAS
VGDRVNIACSA<u>SSSVS</u>YMHWFQQKPGKSPKLWIY<u>STS</u>NLASGVPSRFSGSGSGTDYSLTI
SSMQPEDAATYYCQQ<u>RSSYPL</u>TFGGGTKLEIKAAAGSGGSGGEINGSANYEMFIFHNGG
VQILCKYPDIVQQFKMQLLKGGQILCDLTKTKGSGNTVSIKSLKFCHSQLSNNSVSFFLY
NLDHSHANYYFCNLSIFDPPPFKVTLTGGYLHIYESQLCCQLKFWLPIGCAAFVVVCILG
CILICWLTKKKYSSSVHDPNGEYMFMRAVNTAKKSRLTDVTLKKVAKKPTNKAPHPKQ
EPQEINFPDDLPGSNTAAPVQETLHGCQPVTQEDGKESRISVQERQ hOncostatin-M signal peptide SEQ ID NO: 1
MGVLLTQRTLLSLVLALLFPSMASM

Humanized MFE23 VH SEQ ID NO: 12
QVKLEQSGAEVVKPGASVKLSCKAS<u>GFNIKDS</u>YMHWLRQGPGQRLEWIGWI<u>DPENGDT</u>
EYAPKFQGKATFTTDTSANTAYLGLSSLRPEDTAVYYCNEG<u>TPTGPYYFD</u>YWGQGTLV
TVSS

3xG4S linker SEQ ID NO: 12
GGGGSGGGGSGGGGS

Humanized MFE23 VL SEQ ID NO: 12
ENVLTQSPSSMSASVGDRVNIACSA<u>SSSVS</u>YMHWFQQKPGKSPKLWIY<u>STS</u>NLASGVPS
RFSGSGSGTDYSLTISSMQPEDAATYYCQQ<u>RSSYPL</u>TFGGGTKLEIK

Linker SEQ ID NO: 18
AAAGSGGSG

Human ICOS (Inducible T-cell costimulator) Q9Y6W8 SEQ ID NO: 515
GEINGSANYEMFIFHNGGVQILCKYPDIVQQFKMQLLKGGQILCDLTKTKGSGNTVSIKS
LKFCHSQLSNNSVSFFLYNLDHSHANYYFCNLSIFDPPPFKVTLTGGYLHIYESQLCCQL
KFWLPIGCAAFVVVCILGCILICWLTKKKYSSSVHDPNGEYMFMRAVNTAKKSRLTDVT
L

Human CD40 Intracellular Domain SEQ ID NO: 32

KKVAKKPTNKAPHPKQEPQEINFPDDLPGSNTAAPVQETLHGCQPVTQEDGKESRISVQ
ERQ

FIG. 83

MSLN Constructs

SS1 scFv CoStAR CTP224 SEQ ID NO: 192
MGVLLTQRTLLSLVLALLFPSMASMQVQLQQSGPELEKPGASVKLSCKASGYSFTGYTMNWVK
QSHGKSLEWIGLITPYNGASSYNQKFRGKATLTVDKSSSTAYMDLLSLTSEDSAVYFCARGGYD
GRGFDYWGQGTTVTVSSGGGGSGGGGSGGGGSDIELTQSPAIMSASPGEKVTMTCSASSSVSYM
HWYQQKSGTSPKRWIYDTSKLASGVPGRFSGSGSGNSYSLTISSVEAEDDATYYCQQWSKHPLT
FGAGTKLEIKAAAGSGGSGILVKQSPMLVAYDNAVNLSCKYSYNLFSREFRASLHKGLDSAVEV
CVVYGNYSQQLQVYSKTGFNCDGKLGNESVTFYLQNLYVNQTDIYFCKIEVMYPPPYLDNEKS
NGTIIHVKGKHLCPSPLFPGPSKPFWVLVVVGGVLACYSLLVTVAFIIFWVRSKRSRLLHSDYMN
MTPRRPGPTRKHYQPYAPPRDFAAYRSKKVAKKPTNKAPHPKQEPQEINFPDDLPGSNTAAPVQ
ETLHGCQPVTQEDGKESRISVQERQ

M5 scFv CoStAR CTP225 SEQ ID NO: 210
MGVLLTQRTLLSLVLALLFPSMASMQVQLVQSGAEVEKPGASVKVSCKASGYTFTDYYMHWV
RQAPGQGLEWMGWINPNSGGTNYAQKFQGRVTMTRDTSISTAYMELSRLRSDDTAVYYCASG
WDFDYWGQGTLVTVSSGGGGSGGGGSGGGGSDIVMTQSPSSLSASVGDRVTITCRASQSIRYYL
SWYQQKPGKAPKLLIYTASILQNGVPSRFSGSGSGTDFTLTISSLQPEDFATYYCLQTYTTPDFGP
GTKVEIKAAAGSGGSGILVKQSPMLVAYDNAVNLSCKYSYNLFSREFRASLHKGLDSAVEVCVV
YGNYSQQLQVYSKTGFNCDGKLGNESVTFYLQNLYVNQTDIYFCKIEVMYPPPYLDNEKSNGTII
HVKGKHLCPSPLFPGPSKPFWVLVVVGGVLACYSLLVTVAFIIFWVRSKRSRLLHSDYMNMTPR
RPGPTRKHYQPYAPPRDFAAYRSKKVAKKPTNKAPHPKQEPQEINFPDDLPGSNTAAPVQETLH
GCQPVTQEDGKESRISVQERQ

HN1 scFv CoStAR CTP 226 SEQ ID NO: 228
MGVLLTQRTLLSLVLALLFPSMASMQVQLVQSGAEVKRPGASVQVSCRASGYSINTYYMQWVR
QAPGAGLEWMGVINPSGVTSYAQKFQGRVTLTNDTSTNTVYMQLNSLTSADTAVYYCARWAL
WGDFGMDVWGKGTLVTVSSGGGGSGGGGSGGGGSDIQMTQSPSTLSASIGDRVTITCRASEGIY
HWLAWYQQKPGKAPKLLIYKASSLASGAPSRFSGSGSGTDFTLTISSLQPDDFATYYCQQYSNYP
LTFGGGTKLEIKAAAGSGGSGILVKQSPMLVAYDNAVNLSCKYSYNLFSREFRASLHKGLDSAV
EVCVVYGNYSQQLQVYSKTGFNCDGKLGNESVTFYLQNLYVNQTDIYFCKIEVMYPPPYLDNE
KSNGTIIHVKGKHLCPSPLFPGPSKPFWVLVVVGGVLACYSLLVTVAFIIFWVRSKRSRLLHSDY
MNMTPRRPGPTRKHYQPYAPPRDFAAYRSKKVAKKPTNKAPHPKQEPQEINFPDDLPGSNTAAP
VQETLHGCQPVTQEDGKESRISVQERQ

M912 scFv CoStAR CTP 227 SEQ ID NO: 246
MGVLLTQRTLLSLVLALLFPSMASMQVQLQESGPGLVKPSETLSLTCTVSGGSVSSGSYYWSWI
RQPPGKGLEWIGYIYYSGSTNYNPSLKSRVTISVDTSKNQFSLKLSSVTAADTAVYYCAREGKNG
AFDIWGQGTMVTVSSGGGGSGGGGSGGGGSDIQMTQSPSSLSASVGDRVTITCRASQSISSYLN
WYQQKPGKAPKLLIYAASSLQSGVPSGFSGSGSGTDFTLTISSLQPEDFATYYCQQSYSTPLTFGG
GTKVEIKAAAGSGGSGILVKQSPMLVAYDNAVNLSCKYSYNLFSREFRASLHKGLDSAVEVCVV
YGNYSQQLQVYSKTGFNCDGKLGNESVTFYLQNLYVNQTDIYFCKIEVMYPPPYLDNEKSNGTII
HVKGKHLCPSPLFPGPSKPFWVLVVVGGVLACYSLLVTVAFIIFWVRSKRSRLLHSDYMNMTPR
RPGPTRKHYQPYAPPRDFAAYRSKKVAKKPTNKAPHPKQEPQEINFPDDLPGSNTAAPVQETLH
GCQPVTQEDGKESRISVQERQ

FIG. 84A huTP218 scFv CoStAR CTP228 SEQ ID NO: 264
MGVLLTQRTLLSLVLALLFPSMASMEVQLVESGGGLVQPGGSLRLSCAASGFDLGFYFYACWV
RQAPGKGLEWVSCIYTAGSGSTYYASWAKGRFTISRDNSKNTLYLQMNSLRAEDTAVYYCARS
TANTRSTYYLNLWGQGTLVTVSSGGGGSGGGGSGGGGSDIQMTQSPSSLSASVGDRVTITCQAS
QRISSYLSWYQQKPGKVPKLLIYGASTLASGVPSRFSGSGSGTDFTLTISSLQPEDVATYYCQSYA
YFDSNNWHAFGGGTKVEIAAAGSGGSGILVKQSPMLVAYDNAVNLSCKYSYNLFSREFRASLH
KGLDSAVEVCVVYGNYSQQLQVYSKTGFNCDGKLGNESVTFYLQNLYVNQTDIYFCKIEVMYP
PPYLDNEKSNGTIIHVKGKHLCPSPLFPGPSKPFWVLVVVGGVLACYSLLVTVAFIIFWVRSKRSR
LLHSDYMNMTPRRPGPTRKHYQPYAPPRDFAAYRSKKVAKKPTNKAPHPKQEPQEINFPDDLPG
SNTAAPVQETLHGCQPVTQEDGKESRISVQERQ

P4 scFv CoStAR CTP229 SEQ ID NO: 282
MGVLLTQRTLLSLVLALLFPSMASMQVQLQQSGPGLVTPSQTLSLTCAISGDSVSSNSATWNWIR
QSPSRGLEWLGRTYYRSKWYNDYAVSVKSRMSINPDTSKNQFSLQLNSVTPEDTAVYYCARGM
MTYYYGMDVWGQGTTVTVSSGGGGSGGGGSGGGGSQPVLTQSSSLSASPGASASLTCTLRSGI
NVGPYRIYWYQQKPGSPPQYLLNYKSDSDKQQGSGVPSRFSGSKDASANAGVLLISGLRSEDEA
DYYCMIWHSSAAVFGGGTQLTVLSAAAGSGGSGILVKQSPMLVAYDNAVNLSCKYSYNLFSRE
FRASLHKGLDSAVEVCVVYGNYSQQLQVYSKTGFNCDGKLGNESVTFYLQNLYVNQTDIYFCKI
EVMYPPPYLDNEKSNGTIIHVKGKHLCPSPLFPGPSKPFWVLVVVGGVLACYSLLVTVAFIIFWV
RSKRSRLLHSDYMNMTPRRPGPTRKHYQPYAPPRDFAAYRSKKVAKKPTNKAPHPKQEPQEINF
PDDLPGSNTAAPVQETLHGCQPVTQEDGKESRISVQERQ hOncostatin-M signal peptide SEQ ID NO: 1
MGVLLTQRTLLSLVLALLFPSMASM

Linker SEQ ID NO: 18
AAAGSGGSG

STM-spCD28 SEQ ID NO: 19
ILVKQSPMLVAYDNAVNLSCKYSYNLFSREFRASLHKGLDSAVEVCVVYGNYSQQLQVYSKTG
FNCDGKLGNESVTFYLQNLYVNQTDIYFCKIEVMYPPPYLDNEKSNGTIIHVKGKHLCPSPLFGP
SKPFWVLVVVGGVLACYSLLV TVAFIIFWV

Sig-CD28 SEQ ID NO: 25
RSKRSRLLHSDYMNMTPRRPGPTRKHYQPYAPPRDFAAYRS

CD40 SEQ ID NO: 32
KKVAKKPTNK APHPKQEPQEINFPDDLPGSNTAAPVQETLHGCQPVTQEDGKESRISVQERQ

FIG. 84B

SS1 scFv SEQ ID NO: 186
QVQLQQSGPELEKPGASVKLSCKASGYSFTGYTMNWVKQSHGKSLEWIGL**ITPYNGASSYNQ
KFRGKATLTVDKSSSTAYMDLLSLTSEDSAVYFCARGGYDGRGFDY**WGQGTTVTV*SSGGGGS
GGGGSGGGGS*DIELTQSPAIMSASPGEKVTMTCSASSSVSYMHWYQQKSGTSPKRWIY**DTSKLA
SGVPGRFSGSGSGNSYSLTISSVEAEDDATYCQQWSKHPLT**FGAGTKLEIK

M5 scFv SEQ ID NO: 187
QVQLVQSGAEVEKPGASVKVSCKASGYTFTDYYMHWVRQAPGQGLEWMG**WINPNSGGTNY
AQKFQGRVTMTRDTSISTAYMELSRLRSDDTAVYYCASGWDFDY**WGQGTLVTV*SSGGGGSGG
GGSGGGGS*DIVMTQSPSSLSASVGDRVTITCRASQSIRYYLSWYQQKPGKAPKLLIY**TASILQNG
VPSRFSGSGSGTDFTLTISSLQPEDFATYYCLQTYTTPD**FGPGTKVEIK

HN1 scFv SEQ ID NO: 188
QVQLVQSGAEVKRPGASVQVSCRASGYSINTYYMQWVRQAPGAGLEWMGV**INPSGVTSYAQ
KFQGRVTLTNDTSTNTVYMQLNSLTSADTAVYYCARWALWGDFGMDV**WGKGTLVTV*SSGG
GGSGGGGSGGGGS*DIQMTQSPSTLSASIGDRVTITCRASEGIYHWLAWYQQKPGKAPKLLIY**KA
SSLASGAPSRFSGSGSGTDFTLTISSLQPDDFATYYCQQYSNYPLTFGGGTKLEIK

M912 scFv SEQ ID NO: 189
QVQLQESGPGLVKPSETLSLTCTVSGGSVSSGSYYWSWIRQPPGKGLEWIGY**IYYSGSTNYNPSL
KSRVTISVDTSKNQFSLKLSSVTAADTAVYYCAREGKNGAFDIW**GQGTMVTV*SSGGGGSGGGG
SGGGGS*DIQMTQSPSSLSASVGDRVTITCRASQSISSYLNWYQQKPGKAPKLLIY**AASSLQSGVPS
GFSGSGSGTDFTLTISSLQPEDFATYYCQQSYSTPLTFGGGTKVEIK huYP218 scFv SEQ ID NO: 190
EVQLVESGGGLVQPGGSLRLSCAASGFDLGFYFYACWVRQAPGKGLEWVSCIYTAGSGSTYY
ASWAKGRFTISRDNSKNTLYLQMNSLRAEDTAVYYCARSTANTRSTYYLNL**WGQGTLVTV*SSG
GGGSGGGGSGGGGS*DIQMTQSPSSLSASVGDRVTITCQASQRISSYLSWYQQKPGKVPKLLIY**GA
STLASGVPSRFSGSGSGTDFTLTISSLQPEDVATYYCQSYAYFDSNNWHA**FGGGTKVEI

P4 scFv SEQ ID NO: 191
QVQLQQSGPGLVTPSQTLSLTCAISGDSVSSNSATWNWIRQSPSRGLEWLG**RTYYRSKWYNDY
AVSVKSRMSINPDTSKNQFSLQLNSVTPEDTAVYYCARGMMTYYYGMDV**WGQGTTVTV*SSGG
GGSGGGGSGGGGS*QPVLTQSSSLSASPGASASLTCTLRSGINVGPYRIYWYQQKPGSPPQYLLN
YKSDSDKQQGSGVPSRFSGSKDASANAGVLLISGLRSEDEADYYCMIWHSSAAV**FGGGTQLTV
LS

VH, VL, *linker*, CDR

FIG. 84C

RECEPTORS PROVIDING TARGETED COSTIMULATION FOR ADOPTIVE CELL THERAPY

RELATED APPLICATIONS AND INCORPORATION BY REFERENCE

This application claims the benefit of U.S. Provisional Ser. No. 63/211,042 and U.S. Provisional Ser. No. 63/211,046, both filed Jun. 16, 2021; U.S. Provisional Ser. No. 63/222,913, filed Jul. 16, 2021; and U.S. Provisional Ser. No. 63/301,340 filed Jan. 20, 2022, each of which is hereby incorporated by reference in their entireties.

SEQUENCE STATEMENT

The instant application contains a Sequence Listing, which has been submitted electronically and is hereby incorporated by reference in its entirety. The sequence listing, was created on Jun. 15, 2022, is named SeqListing-INSTB007A and is 1,634,598 bytes in size.

Reference is made to GB patent application Serial No. 1900858.0, filed 22 Jan. 2019, U.S. patent application Ser. No. 62/951,770, filed 20 Dec. 2019, International application PCT/GB2020/050120, filed 20 Jan. 2020, and U.S. provisional patent applications 63/053,494 and 63/053,498, filed Jul. 17, 2020.

The foregoing applications, and all documents cited therein or during their prosecution ("appln cited documents") and all documents cited or referenced in the appln cited documents, and all documents cited or referenced herein ("herein cited documents"), and all documents cited or referenced in herein cited documents, together with any manufacturer's instructions, descriptions, product specifications, and product sheets for any products mentioned herein or in any document incorporated by reference herein, are hereby incorporated herein by reference, and may be employed in the practice of the invention. More specifically, all referenced documents are incorporated by reference to the same extent as if each individual document was specifically and individually indicated to be incorporated by reference.

FIELD OF THE INVENTION

The present invention relates to a chimeric costimulatory antigen receptor (CoStAR) useful in adoptive cell therapy (ACT), and cells comprising the CoStAR. The CoStAR can act as a modulator of cellular activity enhancing responses to defined antigens. The present invention also provides CoStAR and/or fusion proteins, nucleic acids encoding the CoStAR and therapeutic uses thereof.

BACKGROUND

Adoptive cell therapy (ACT) using autologous T-cells to mediate cancer regression has shown much promise in early clinical trials. Several general approaches have been taken such as the use of naturally occurring tumor reactive or tumor infiltrating lymphocytes (TILs) expanded ex vivo. Additionally, T-cells may be genetically modified to retarget them towards defined tumor antigens. This can be done via the gene transfer of peptide (p)-major histocompatibility complex (MHC) specific T-cell Receptors (TCRs) or synthetic fusions between tumor specific single chain antibody fragment (scFv) and T-cell signaling domains (e.g. CD3ζ), the latter being termed chimeric antigen receptors (CARs).

TIL and TCR transfer has proven particularly good when targeting melanoma (Rosenberg et al. 2011; Morgan 2006), whereas CAR therapy has shown much promise in the treatment of certain B-cell malignancies (Grupp et al. 2013).

Costimulatory signals are useful to achieve robust CAR T cell expansion, function, persistence and antitumor activity. The success of CAR therapy in leukemia has been partly attributed to the incorporation of costimulatory domains (e.g. CD28 or CD137) into the CAR construct, signals from which synergize with the signal provided by CD3ζ to enhance anti-tumor activity. The basis of this observation relates to the classical signal 1/signal 2 paradigm of T-cell activation. Here signal 1, provided by the TCR complex, synergizes with signal 2 provided by costimulatory receptors such as CD28, CD137 or CD134 to permit the cells to undergo clonal expansion, IL2 production and long term survival without the activation induced cell death (AICD) associated with signal 1 alone. Furthermore the involvement of signal 2 enhances the signal generated through signal 1 allowing the cells to respond better to low avidity interactions such as those encountered during anti-tumor responses.

Citation or identification of any document in this application is not an admission that such document is available as prior art to the present invention.

SUMMARY

Provided herein are novel chimeric costimulatory antigen receptors (CoStARs) that bind to carcinoembryonic antigen (CEA) and/or mesothelin (MSLN) and cells comprising or expressing the CoStARs which are beneficial for CAR and non-CAR based T-cell therapies alike. Provided herein are cells that express a novel chimeric costimulatory receptor to provide a costimulatory signal to T-cells upon engagement with a defined disease-associated, for example tumor-associated, antigen.

There have been several reports in which split signal 1 and signal 2 have been used to drive antigen specific responses in engineered T-cells (Alvarez-Vallina & Hawkins 1996). However, none have utilized the full length CD28 molecule. There are specific advantages to using full length receptors, such as CD28 as opposed to truncated forms. A full length receptors may be capable of dimerization, enabling the receptor to function in its native form, indeed chimeric antigen receptors fail to function optimally when expressed as a monomer (Bridgeman et al. 2010).

In an embodiment, a CoStAR induces signal 2 upon engagement with a defined antigen such as a disease associated or tumor associated antigen. The full length CD28 molecule contains motifs critical to its native function in binding members of the B7 family of receptors; although this is potentially dangerous from the perspective of CARs carrying CD28 and CD3ζ receptors in tandem, wherein ligation of CAR by B7 could trigger T-cell activation, there are beneficial qualities for receptors harbouring signal 2 receptors alone. Provided herein is a targeted chimeric costimulatory receptor (CoStAR) which comprises an extracellular binding domain operatively linked to a transmembrane domain, a first signaling domain, and a CD40 signaling domain or a signaling fragment thereof. It has been discovered that costimulatory receptors comprising a CD40 signaling domain display novel and improved activity profiles.

In some embodiments, the CD40 signaling domain comprises SEQ ID NO:32, SEQ ID NO:33, or SEQ ID NO:34. In some embodiments, the CD40 signaling fragment comprises an SH3 motif (KPTNKAPH, SEQ ID NO:35), TRAF2 motif (PKQE, SEQ ID NO:36, PVQE, SEQ ID NO:37, SVQE, SEQ ID NO:38), TRAF6 motif (QEPQEINFP, SEQ ID NO:39), PKA motif (KKPTNKA, SEQ ID NO:40, SRISVQE, SEQ ID NO:41), or a combination thereof, or is a full length CD40 intracellular domain. In some embodiments, one or more of the SH3, TRAF2, TRAF6, or PKA motifs of the CD40 signaling domain is mutated.

In some embodiments, the first signaling domain of the CoStAR comprises a signaling domain or signaling fragment of a receptor, such as, for example a tumor necrosis factor receptor superfamily (TNFRSF) receptor, including but not limited to CD2, CD9, CD26, CD27, CD28, CD29, CD38, CD40, CD43, CD46, CD49d, CD55, CD73, CD81, CD82, CD99, CD100, CD134 (OX40), CD137 (41BB), CD150 (SLAM), CD270 (HVEM), CD278 (ICOS), DAP10, NTKR, CD357 (GITR), or EphB6. In some embodiments, the CoStAR comprises CD2, CD9, CD26, CD27, CD28, CD29, CD38, CD40, CD43, CD46, CD49d, CD55, CD73, CD81, CD82, CD99, CD100, CD134 (OX40), CD137 (41BB), CD150 (SLAM), CD270 (HVEM), CD278 (ICOS), DAP10, NTKR, CD357 (GITR), or EphB6. In embodiments, wherein the first signaling domain comprises a CD40 signaling domain thus the CoStAR comprises elements of two CD40 signaling domains.

In some embodiments, the CoStAR comprises a second signaling domain or signaling fragment of a receptor, such as, for example a tumor necrosis factor receptor superfamily (TNFRSF) receptor, including but not limited to CD2, CD9, CD26, CD27, CD28, CD29, CD38, CD40, CD43, CD46, CD49d, CD55, CD73, CD81, CD82, CD99, CD100, CD134 (OX40), CD137 (41BB), CD150 (SLAM), CD270 (HVEM), CD278 (ICOS), CD357 (GITR), or EphB6. The first signaling domain or signaling fragment, the CD40 signaling domain or signaling fragment, and the second signaling domain or signaling fragment can be in any order. Exemplary embodiments include, without limitation, CoStAR which comprise CD28, CD137, and CD40 signaling domains, CD28, CD134, and CD40 signaling domains, CD28, CD2, and CD40 signaling domains, CD28, GITR, and CD40 signaling domains, CD28, CD29, and CD40 signaling domains, or CD28, CD150, and CD40 signaling domains.

In some embodiments, the extracellular antigen-binding domain (e.g., without limitation CEA-binding domain, MSLN-binding domain) of a CoStAR of the invention is operatively linked to the transmembrane domain by a linker and/or a spacer. In some embodiments, the linker comprises from about 5 to about 20 amino acids. In some embodiments, the linker comprises AAAGSGGSG (SEQ ID NO:18).

In some embodiments, a CoStAR comprises a spacer which operatively links the extracellular binding domain to the transmembrane domain and comprises from about 10 to about 250 amino acids. In some embodiments, the spacer comprises an extracellular sequence of CD8 or CD28 or a fragment thereof. In some embodiments, the CoStAR comprises a second extracellular binding domain. In some embodiments, the second binding domain comprises an extracellular ligand binding domain from CD8 or CD28. In some embodiments, the spacer comprises one or more immunoglobulin domains or an immunoglobulin constant region. In some embodiments, the spacer comprises one or more immunoglobulin domains or an immunoglobulin constant region such as, without limitation, SEQ ID NO:24.

In some embodiments the transmembrane domain of a CoStAR comprises a transmembrane domain of a TNFRSF protein. In some embodiments, a transmembrane domain of a CoStAR comprises a transmembrane domain of CD28 or CD8. In some embodiments, a transmembrane domain of a CoStAR comprises a transmembrane sequence of CD28 or CD8.

In some embodiments, the CoStARs are useful to stimulate an immune response against a selected target that expresses a tumor associated antigen (TAA), e.g. without limitation, carcinoembryonic antigen (CEA), mesothelin (MSLN), or other. In some embodiments, the CoStAR comprises an antigen binding fragment of the scFv of SEQ ID NO:9, SEQ ID NO:10, SEQ ID NO:11, SEQ ID NO:12, SEQ ID NO:13, or SEQ ID NO:14, e.g., a fragment comprising one, two, three, four, five, or all six complementary determining regions (CDRs). In some embodiments, the CoStAR comprises the scFv of SEQ ID NO:9, SEQ ID NO:10, SEQ ID NO:11, SEQ ID NO:12, SEQ ID NO:13, or SEQ ID NO:14. In some embodiments, the CoStAR comprises an antigen binding fragment of the scFv of a) SEQ ID NO:186, SEQ ID NO:187, SEQ ID NO:188, SEQ ID NO:189, SEQ ID NO:190, or SEQ ID NO:191; or b) SEQ ID NO:510, SEQ ID NO:511, SEQ ID NO:512, or SEQ ID NO:513, e.g., a fragment comprising one, two, three, four, five, or all six CDRs. In some embodiments, the CoStAR comprises the scFv of a) SEQ ID NO:186, SEQ ID NO:187, SEQ ID NO:188, SEQ ID NO:189, SEQ ID NO:190, SEQ ID NO:191; or b) SEQ ID NO:508, SEQ ID NO:509, SEQ ID NO:510, SEQ ID NO:511, SEQ ID NO:512, or SEQ ID NO:513.

In some embodiments, an extracellular binding domain can comprise, without limit, an scFv, a peptide, an antigen binding portion of an antibody, an antibody heavy-chain variable domain, an antibody light chain variable domain, a single domain antibody, a CEA ligand, or an MSLN ligand.

In some embodiments, a CoStAR comprises a CD3ζ signaling domain, for example located at the C-terminus.

In some embodiments, a CoStAR comprises an N-terminal signal peptide. In some embodiments, the N-terminal signal peptides are signal peptides of oncostatin M (OSM), CD8α, CD2, interleukin-2 (IL-2), granulocyte-macrophage colony stimulating factor (GM-CSF), and human IgGκ.

In some embodiments, there is provided a nucleic acid which encodes a CoStAR. The nucleic acid may be optimized, for example be codon optimized for expression in a host cell. In some embodiments, the nucleic acid is codon optimized for expression in a human cell.

In some embodiments, there is provided vector which encodes and is capable of expressing a CoStAR.

In some embodiments, there is provided a cell which expresses a CoStAR. In some embodiments, the cell expresses two or more CoStARs, for example the cell expresses a CoStAR that binds to CEA or MSLN and a CoStAR that binds to FOLR1 or a CoStAR that binds to CA125, such as but not limited to anti-CEA.CD28.CD40 and anti-CA125.41BB.CD40 or anti-MSLN.CD28.CD40 and anti-CA125.41BB.CD40. In some embodiments, the cell expresses a CoStAR which binds to CEA and a CoStAR which binds to PDL1, such as but not limited to anti-CEA.CD28.CD40 and PD1.CD28.CD40 or expresses a CoStAR which binds to MSLN and a CoStAR which binds to PDL1, such as but not limited to anti-MSLN.CD28.CD40 and PD1.CD28.CD40.

In some embodiments, a cell engineered to express a CoStAR comprises an alpha-beta T cell, gamma-delta T cell, T regulatory cell, TIL, NKT cell or NK cell. In some embodiments, a cell engineered to express a CoStAR coexpresses a chimeric antigen receptor (CAR) or a T cell receptor (TCR).

In some embodiments, provided herein is a method of making the cell which expresses a CoStAR which comprises transducing or transfecting a cell with a vector which encodes and is capable of expressing a CoStAR.

In some embodiments, a method is provided for preparing a population of cells that express a CoStAR by transducing or transfecting cells, detecting expression of the CoStAR and enriching, expanding, and/or selecting cells that express the CoStAR.

In some embodiments, provided herein is a method of treating a disease in a subject by administering a population of cells which express a CoStAR.

In some embodiments, a chimeric costimulatory antigen receptor (CoStAR) is provided which comprises: an extracellular binding domain that binds to carcinoembryonic antigen (CEA), or an extracellular binding domain that binds to mesothelin (MSLN), operatively linked to a transmembrane domain, and a first signaling domain and an intracellular domain of ICOS or a signaling fragment thereof, or a first signaling domain and an intracellular domain of NTRK1 or a signaling fragment thereof, or a first signaling domain and an intracellular domain of DAP10 or a signaling fragment thereof, or a first signaling domain and a CD40 signaling domain or a signaling fragment thereof, or a first signaling domain and one or more of a TRAF2/TRAF3 sequence, a TRAF6 sequence, a TRAF2 sequence, or an IProx sequence.

In some embodiments, a CoStAR is provided where the first signaling domain comprises a signaling domain or signaling fragment of CD2, CD9, CD26, CD27, CD28, CD29, CD38, CD40, CD43, CD46, CD49d, CD55, CD73, CD81, CD82, CD99, CD100, CD134 (OX40), CD137 (41BB), CD150 (SLAM), CD270 (HVEM), CD278 (ICOS), CD357 (GITR), or EphB6.

In some embodiments, a CoStAR is provided where the CoStAR comprises a second signaling domain.

In some embodiments, a CoStAR is provided where the second signaling domain comprises a signaling domain or signaling fragment of CD2, CD9, CD26, CD27, CD28, CD29, CD38, CD40, CD43, CD46, CD49d, CD55, CD73, CD81, CD82, CD99, CD100, CD134 (OX40), CD137 (41BB), CD150 (SLAM), CD270 (HVEM), CD278 (ICOS), CD357 (GITR), or EphB6.

In some embodiments, a CoStAR is provided where the CD40 signaling fragment comprises an SH3 motif (KPTNKAPH, SEQ ID NO:35), TRAF2 motif (PKQE, SEQ ID NO:36, PVQE, SEQ ID NO:37, SVQE, SEQ ID NO:38), TRAF6 motif (QEPQEINFP, SEQ ID NO:39), PKA motif (KKPTNKA, SEQ ID NO:40, SRISVQE, SEQ ID NO:41), or a combination thereof, or is a full length CD40 intracellular domain.

In some embodiments, a CoStAR is provided where the first signaling domain comprises a full length costimulatory domain.

In some embodiments, a CoStAR is provided where the extracellular binding domain is operatively linked to the transmembrane domain by a linker and/or a spacer.

In some embodiments, a CoStAR is provided where the linker comprises from about 5 to about 20 amino acids.

In some embodiments, a CoStAR is provided where the linker or spacer comprises from about 10 to about 250 amino acids.

In some embodiments, a CoStAR is provided where the CoStAR comprises a second extracellular binding domain.

In some embodiments, a CoStAR is provided where the second extracellular binding domain comprises a ligand binding domain from CD8, CD28, or ICOS.

In some embodiments, a CoStAR is provided where the transmembrane domain comprises a transmembrane domain from CD28, CD8, ICOS, DAP10, or NTRK.

In some embodiments, a CoStAR is provided where the transmembrane domain comprises the transmembrane domain sequence of SEQ ID NO:20, SEQ ID NO:21, or SEQ ID NO:22.

In some embodiments, a CoStAR is provided where the extracellular binding domain comprises an scFv, a peptide, an antibody heavy-chain variable domain, an antibody light-chain variable domain, or a CEA ligand or a MSLN ligand.

In some embodiments, a CoStAR is provided which further comprises a signaling domain at the C-terminus.

In some embodiments, a CoStAR is provided which further comprises an N-terminal signal peptide.

In some embodiments, a CoStAR is provided where the N-terminal signal peptide comprises the signal peptide of oncostatin M (OSM), CD8α, CD2, interleukin-2 (IL-2), granulocyte-macrophage colony stimulating factor (GM-CSF), or human IgGκ.

In some embodiments, a nucleic acid which encodes any of the CoStAR constructs described above is provided.

In some embodiments, a CoStAR is provided where a vector comprises the CoStAR construct nucleic acid.

In some embodiments, a cell which expresses any of the CoStARs described above is provided.

In some embodiments, the CoStAR expressing cell comprises an alpha-beta T cell, gamma-delta T cell, T regulatory cell, TIL, NKT cell or NK cell.

In some embodiments, the CoStAR expressing cell coexpresses a CAR or a TCR.

In some embodiments, a method of making the CoStar expressing cell is provided. In some embodiments, the method comprises the step of transducing or transfecting a cell with a vector.

In some embodiments, a method for preparing a population of cells that express a CoStAR of any one of of the CoStARs described above is provided. In some embodiments, the method comprises i) detecting expression of the CoStAR on the surface of cells transfected or transduced with a vector of claim 19; and ii) selecting cells which are identified as expressing the CoStAR.

In some embodiments, a cell population is provided which is enriched for cell expression of a of any one of the CoStAR constructs provided above.

In some embodiments, a method for treating a disease in a subject is provided. In some embodiments the method comprises the step of administering a CoStAR expressing cell, or a CoStAr enriched cell population to the subject.

In some embodiments, a fusion protein is provided. In some embodiments, the fusion protein comprises: a binding domain specific for CEA linked to; a transmembrane domain that is linked to; an ICOS domain that is linked to; a CD40 signaling domain.

In some embodiments, a fusion protein is provided. In some embodiments, the fusion protein comprises: a binding domain specific for MSLN linked to; a transmembrane domain that is linked to; a CD28 domain that is linked to; a CD40 signaling domain.

In some embodiments, a fusion protein is provided. In some embodiments, the fusion protein comprises: a first sequence that is at least 70% identical to SEQ ID NO: 12; a second sequence that is a transmembrane domain; a third sequence that is at least 70% identical to SEQ ID NO: 518; and a fourth sequence that is at least 70% identical to SEQ ID NO: 32.

In some embodiments, a fusion protein is provided. In some embodiments, the fusion protein comprises: a first sequence that is at least 70% identical to any one of SEQ ID NO: 186-191; a second sequence that is a transmembrane domain; a third sequence that is at least 70% identical to SEQ ID NO: 25; and a fourth sequence that is at least 70% identical to SEQ ID NO: 32.

In some embodiments, a fusion protein is provided. In some embodiments, the fusion protein comprises: a HCDR1 that is an HCDR1 in SEQ ID NO: 12; a HCDR2 that is an HCDR2 in SEQ ID NO: 12; a HCDR3 that is an HCDR3 in SEQ ID NO: 12; a LCDR1 that is an LCDR1 in SEQ ID NO: 12; a LCDR2 that is an LCDR2 in SEQ ID NO: 12; a LCDR3 that is an HCDR3 in SEQ ID NO: 12. In some embodiments, 1, 2, 3, 4, 5, or 6 of the LCDRs can include 1, 2, or 3 point mutations. In some embodiments the fusion protein further comprises a second sequence that is a transmembrane domain; a third sequence that is at least 70% identical to SEQ ID NO: 515; and a fourth sequence that is at least 70% identical to SEQ ID NO: 32.

In some embodiments, the fusion protein further comprises a signal peptide sequence that is at least 70% identical to SEQ ID NO: 1.

In some embodiments, the fusion protein further comprises a linker sequence that is at least 70% identical to SEQ ID NO: 18.

In some embodiments, the fusion protein further comprises an ICOS sequence that is at least 70% identical to SEQ ID NO: 515.

In some embodiments, the fusion protein further comprises an CD40 sequence that is at least 70% identical to SEQ ID NO: 32.

In some embodiments, a fusion protein is provided. In some embodiments, the fusion protein comprises: a HCDR1 that is an HCDR1 in SEQ ID NOs: 186-191; a HCDR2 that is an HCDR2 in SEQ ID NOs: 186-191; a HCDR3 that is an HCDR3 in SEQ ID NOs: 186-191; a LCDR1 that is an LCDR1 in SEQ ID NOs: 186-191; a LCDR2 that is an LCDR2 in SEQ ID NOs: 186-191; a LCDR3 that is an HCDR3 in SEQ ID NOs: 186-191. In some embodiments, 1, 2, 3, 4, 5, or 6 of the LCDRs can include 1, 2, or 3 point mutations. In some embodiments, the fusion protein further comprises a second sequence that is a transmembrane domain; a third sequence that is at least 70% identical to SEQ ID NO: 25; and a fourth sequence that is at least 70% identical to SEQ ID NO: 32

In some embodiments, the fusion protein further comprises a signal peptide sequence that is at least 70% identical to SEQ ID NO: 1.

In some embodiments, the fusion protein further comprises a linker sequence that is at least 70% identical to SEQ ID NO: 18.

In some embodiments, the fusion protein further comprises an CD28 TM sequence that is at least 70% identical to SEQ ID NO: 19.

In some embodiments, the fusion protein further comprises an CD28 sequence that is at least 70% identical to SEQ ID NO: 25.

In some embodiments, the fusion protein further comprises an CD40 sequence that is at least 70% identical to SEQ ID NO: 32.

In some embodiments, a method of cell therapy is provided comprising: a) identifying a subject, wherein the subject has cancer that expresses MSLN or CEA; and b) administering any one or more of the CoSTaRs or fusion proteins described above.

In some embodiments, a method of treating a cancer in a subject that expresses MSLN or CEA is provided, the method comprising: a) identifying a subject, wherein the subject has cancer that expresses MSLN or CEA; and b) administering any one or more of the CoSTaRs or fusion proteins described above.

Accordingly, in some embodiments, it is intended not to encompass any previously known product, process of making the product, or method of using the product such that Applicants reserve the right and hereby disclose a disclaimer of any previously known product, process, or method. It is further noted that it is not intended to encompass any product, process, or making of the product or method of using the product, which does not meet the written description and enablement requirements of the USPTO (35 U.S.C. § 112, first paragraph) or the EPO (Article 83 of the EPC), such that Applicants reserve the right and hereby disclose a disclaimer of any previously described product, process of making the product, or method of using the product. It may be advantageous in the practice various embodiments in compliance with Art. 53(c) EPC and Rule 28(b) and (c) EPC. All rights to explicitly disclaim any embodiments that are the subject of any granted patent(s) of applicant in the lineage of this application or in any other lineage or in any prior filed application of any third party is explicitly reserved. Nothing herein is to be construed as a promise.

It is noted that in this disclosure and particularly in the claims and/or paragraphs, terms such as "comprises", "comprised", "comprising" and the like can have the meaning attributed to it in U.S. Patent law; e.g., they can mean "includes", "included", "including", and the like; and that terms such as "consisting essentially of" and "consists essentially of" have the meaning ascribed to them in U.S. Patent law, e.g., they allow for elements not explicitly recited, but exclude elements that are found in the prior art or that affect a basic or novel characteristic of the invention.

These and other embodiments are disclosed or are obvious from and encompassed by, the following Detailed Description.

BRIEF DESCRIPTION OF THE DRAWINGS

The following detailed description, given by way of example, but not intended to limit the invention solely to the specific embodiments described, may best be understood in conjunction with the accompanying drawings.

Figure 1:
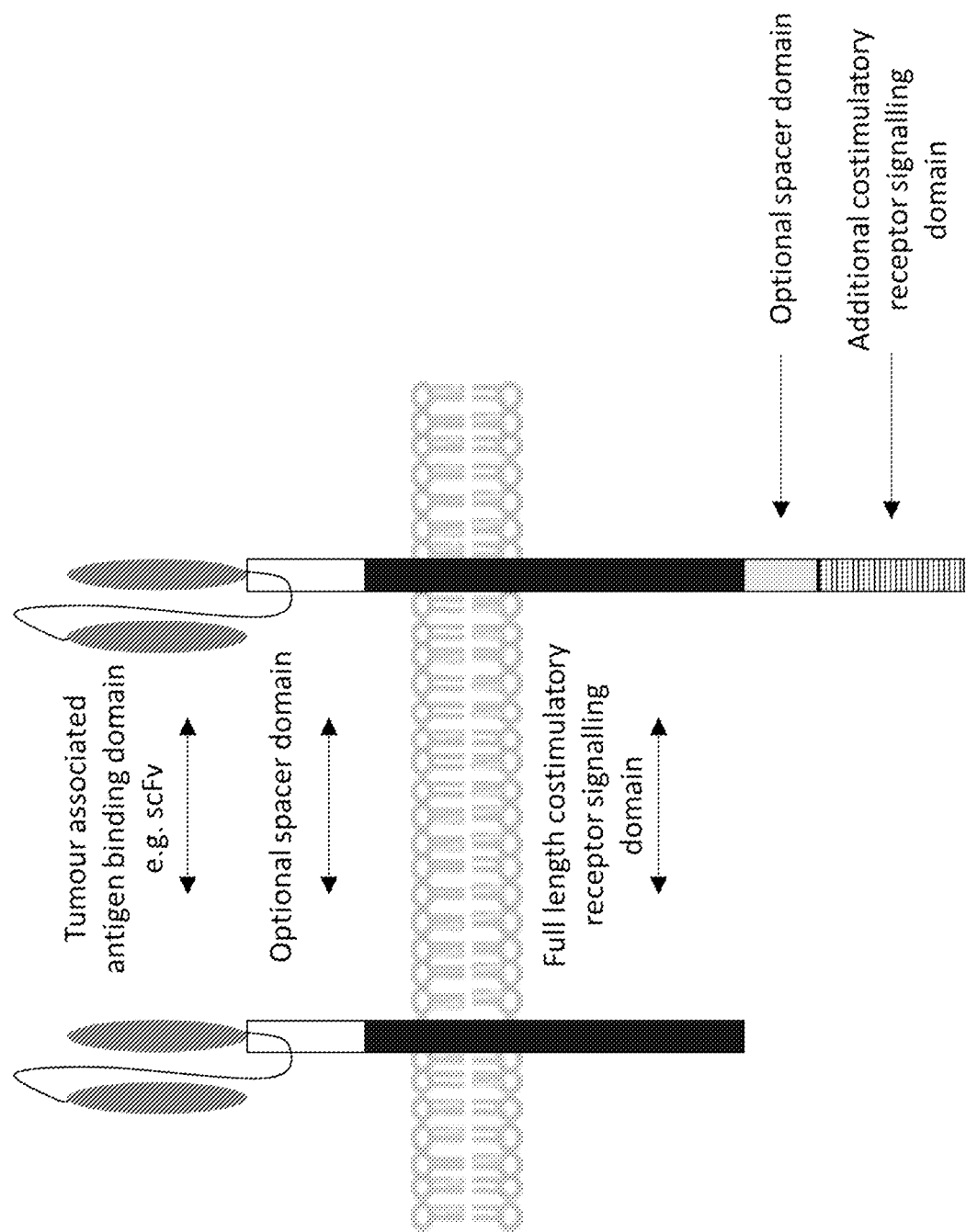
FIG. 1—Structural organisation of single costimulatory and fusion costimulatory domain receptors. A schematic representation of CoStAR receptors set out in the claims is shown. First a CoStAR based on a single costimulatory receptor, and secondly a fusion CoStAR consisting of a full length costimulatory receptor signalling domain fused to a second costimulatory domain.
Figure 2:
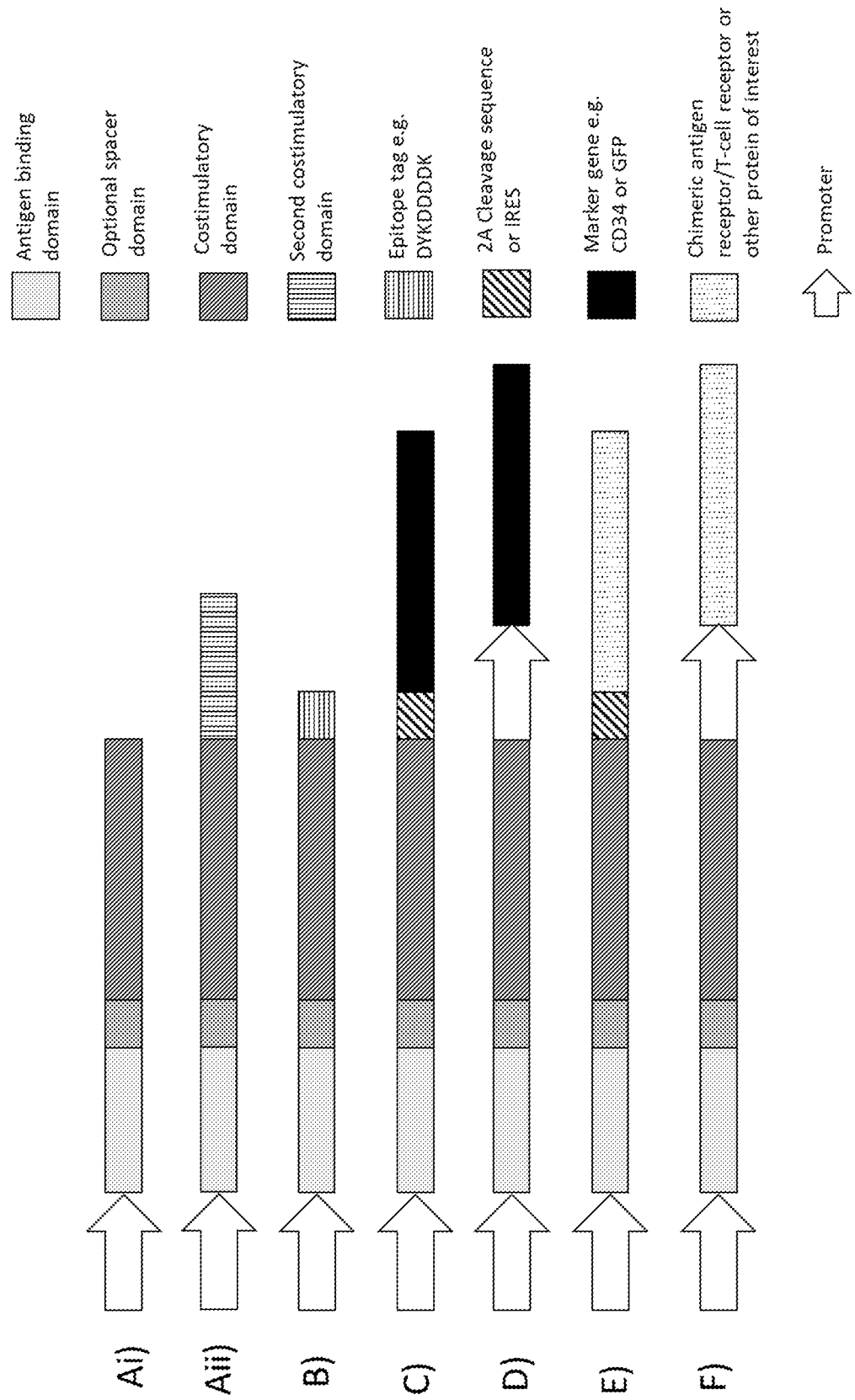
FIG. 2—Genomic organisation of potential CoStAR configurations—The CoStAR consists of an antigen binding domain, an optional spacer domain and a costimulatory domain as shown in figure and described in claims. The CoStAR may be expressed: A) alone from a promoter with the CoStAR consisting of a single (Ai) or fusion (Aii) costimulatory receptor; B) may be expressed with an epitope tag (e.g. His tag, DYKDDDDK (SEQ ID NO:449) etc) at the N or C-terminus to enable direct staining of the CoStAR; C) along with a marker gene separated using a 2A cleavage sequence or internal ribosomal entry site (IRES); D) along with a marker gene which is expressed from a second promoter; E) along with a protein of interest such as a chimeric antigen receptor or T-cell receptor separated using a 2A cleavage sequence or internal ribosomal entry site (IRES); F) along with a protein of interest such as a chimeric antigen receptor or T-cell receptor which is expressed from a second promoter. It would be clear to an individual with sufficient knowledge that the CoStAR and marker gene/chimeric antigen receptor/T-cell receptor/other protein of interest could be expressed in either orientation or 3' (3-prime) or 5' (5-prime) to one another.

FIG. 13A-13M depicts cytokine production by mock, MFE23.CD28 or MFE23.CD28.CD40 engineered T-cells. Bead array analysis was performed on supernatants obtained from T-cell/tumour cocultures. Engineered T-cells were incubated at a 1:1 effector:target ratio with LoVo-OKT3 cells for 24 hours and supernatant collected. Conditioned supernatant was also collected from an equal number of T-cells alone, or LoVo-OKT3 cells alone. Cytokine production was analysed using a Legendplex™ Human TH1/TH2 cytokine panel (Biolegend). (13A) IL-2; (13B) IFN-γ; (13C) TNFα; (13D) IL-4; (13E) IL-5; (13F) IL-13; (13G) IL-17A; (13H) IL-17F; (13I) IL-22; (13J) IL-6; (13K) IL-10; (13L) IL-9; (13M) IL-21. Cytokines were either very low or undetectable in media from T-cells or tumour alone. When cocultured with tumor, cytokine production was enhanced. MFE23.CD28 enhanced production of IL-2, IL-5, IL-17A/17F, IL-10, IL-9 and IL-21 compared to mock. MFE23.CD28.CD40 also enhanced production of TNFα, IL-13 and IL-22. MFE23.CD28.CD40 and further enhanced the production of a number of cytokines greater than that provided by MFE23.CD28 (IL-2, IL-9 and IL-17F), as well as reducing the production of some cytokines below the levels seen with MFE23.CD28 (IL-5 and IL-10). Together this data demonstrates that addition of CD40 to CD28-based costimulatory receptors enhances and/or modulates their specific activity with respect to chemokine production.

FIG. 14A-14M depicts an analysis of chemokines using a Legendplex™ Human Pro inflammatory chemokine panel. (14A) IL-8 (CXCL8); (14B) IP-10 (CSCL10); (14C) Eotaxin (CCL11); (14D) TARC (CCL17); (14E) MCP-1 (CCL2); (14F) RANTES (CCL5); (14G) MIP-1a (CCL3) (14H) MIG (CXCL9) (14I) ENA-78 (CXCL5) (14J) MIP-3a (CCL20) (14K) GROα (CXCL1) (14L) I-TAC (CXCL11) (14M) MEP-1β (CCL4). Chemokines were either very low or undetectable in media from T-cells alone. When cocultured with tumor, chemokine production was enhanced. MFE23.CD28 enhanced production of CXCL5, CXCL10, CXCL11, CCL17 and CCL20 compared to mock. MFE23.CD28.CD40 also enhanced production of CCL2, CXCL1 and CXCL9. MFE23.CD28.CD40 further enhanced the production of a number of cytokines greater than that provided by MFE23.CD28 (CXCL1, CXCL9, CXCL10, CXCL11, CCL17, CCL2, CXCL9, CCL5 and CCL20), as well as reducing the production of some cytokines below the levels seen with MFE23.CD28 (CCL4). Together this data demonstrates that addition of CD40 to CD28-based costimulatory receptors enhances and/or modulates their specific activity with respect to chemokine production.

FIG. 15A-15H depicts functional activity of ovarian CoStAR engineered cells using a CoStAR harbouring a FolR or CA125 reactive scFv (MOV19 & 196-14 respectively). Human folate receptor alpha (FolR) represents a suitable target for a number of tumours including ovarian, head and neck, renal and lung and CA125 represents an alternative target for ovarian cancer. Primary human T-cells from six healthy donors were engineered with either 196-14.CD28, 196-14.CD28.CD40, MOV19.CD28 or MOV19.CD28.CD40 receptors, all harbouring a DYKDDDDK epitope tag for detection. Transduced cells were mixed with FolR+/CA125+OVCAR-OKT3 cells before analysis of effector activity using intracellular staining in the epitope tag positive and negative populations. Specific enhancement of effector activity determined by production of IL-2 (15A and 15B), TNFα (15C and 15D), CD137 (15E and 15F), and BCL-xL (15G and 15H) was observed in in CD28 and CD28.CD40 engineered cells in response to both CA125 and FolR, except for specific BCL-xL induction by MOV19.CD28 which was not observed compared to MOV19.CD28.CD40.

FIG. 16A-16F depicts three TIL populations mock transduced or engineered with MOV19.CD28.CD40 CoStAR and then mixed with patient matched tumor digest. The donor tumors displayed varying levels of FolR on the digest, ranging from negative (16A), low expression (16B) to high expression (16C). Mock and CoStAR negative TIL in the CoStAR engineered populations of TIL matched for the FolR negative digest demonstrated similar levels of CD137 upregulation following tumor coculture which was not enhanced by the presence of CoStAR (16D). In the TIL exposed to FolR low expressing digest there was an enhancement in activity in the CoStAR+ cells compared to CoStAR−, with CD137 expression increasing from <10% to >20% (16E). In the TIL exposed to FolR high tumor digest there was an increase in activity from around 20% in the CoStAR− population, up to approximately 50% in the CoStAR+ population (F).

Figures 17A, 17B, 17C:
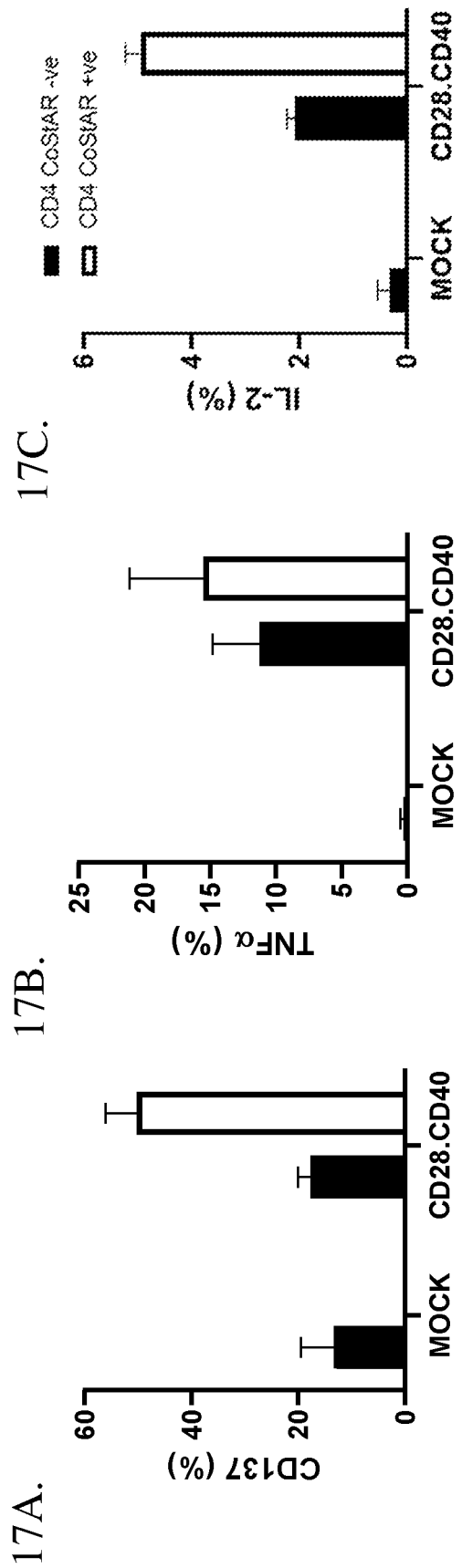

FIG. 17A-17C depicts enhancement of effector functions. A FolR targeting CoStAR enhanced CD137 expression from ~20% to ~50% (17A), TNFα production from 10% to 15% (17B) and IL-2 production from 2% to 5%.(17C) in response to FolR+ tumor digest.

FIG. 18A-18F depicts soluble ligand does not inhibit effector functions. T-cells from three healthy donors were engineered with MOV19.CD28 or MOV19.CD28.CD40 CoStAR and activated with either immobilised OKT3, providing stimulation in the absence of FolR, or with OvCAR-OKT3, to provide TCR and CoStAR activity. BCL-xL activity was increased from between 10 and 20% across the three donors following OKT3 stimulation (18A) whereas IL-2 was increased between 0 and 12% (18B) and TNFα increased between 0 and 20% (18C). The presence of exogenous soluble FolR did not enhance any of these particular effector functions. In the presence of OvCAR-OKT3 BCL-XL induction was enhanced by ~20% in CD28 CoStAR but by ~35% in CD28.CD40 CoStAR (18D), IL-2 induction was enhanced by ~20% in CD28 CoStAR but 30-50% in CD28.CD40 CoStAR (18E) and TNFα production was enhanced by 20-30% in CD28 CoStAR and 25-50% in CD28.CD40 CoStAR (18F). Exogenous soluble FolR did not have an inhibitory effect on any of these effector functions.

Figure 19:
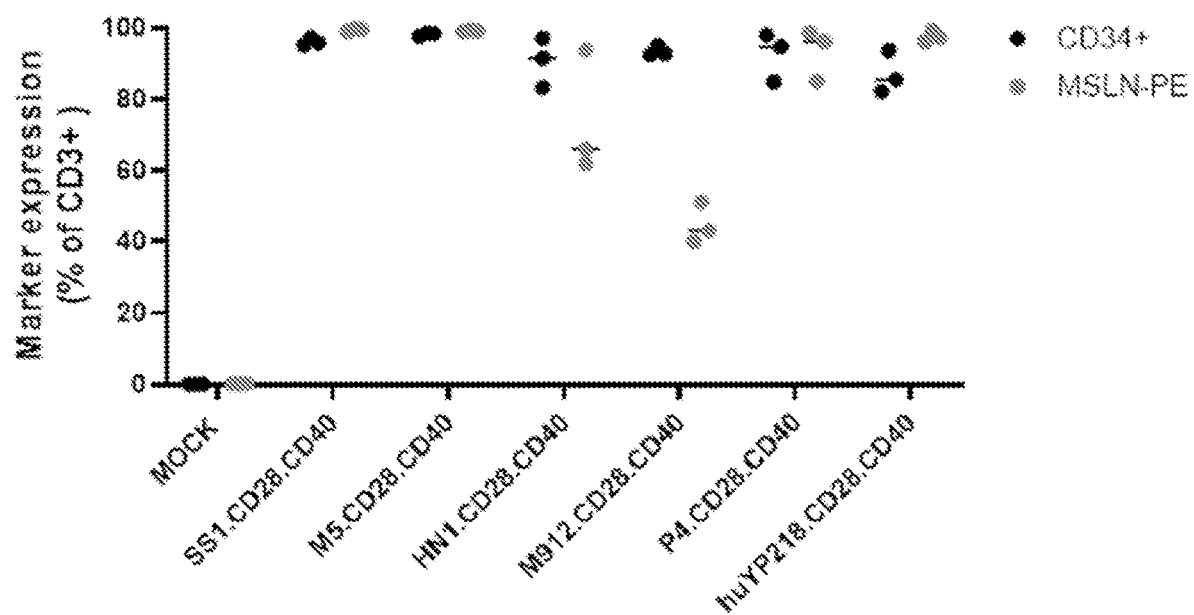

FIG. 19 depicts surface expression of anti-MSLN CoStAR expression on the surface of HD T cells. Transduced and non-transduced (MOCK) cells underwent a rapid expansion protocol (REP) and were assessed for transduction efficiency either via surface detection of the marker gene tCD34 (truncated CD34) or CoStAR molecule using an anti-CD34-APC (black) or anti-MSLN-PE (red) antibody, respectively. The results represent 3 biological replicates.

Figures 20A, 20B, 20C:
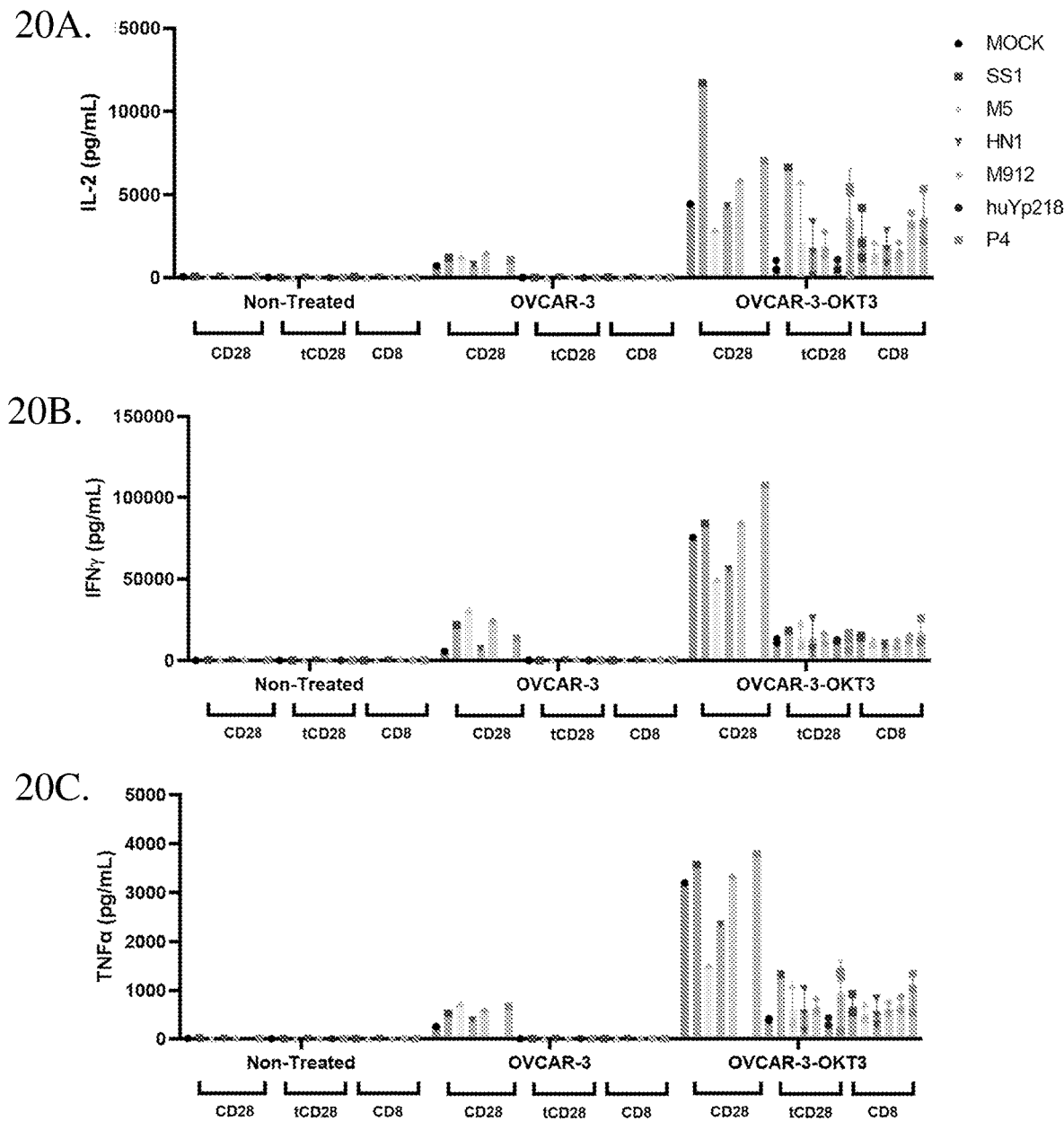

FIG. 20A-20C depicts cytokine expression in healthy donor (HD) T cells transduced with anti-MSLN CoStARs and cocultured with OVCAR-3 cell lines. CoStARs comprising combinations of six different anti-MSLN scFvs (SS1, M5, HN1, M912, huYP218, P4) and three different spacer/transmembrane domains (CD28, N-terminal truncated CD28, CD8) were compared. Structural details are provided in Table 8, Table 9, and Table 10. Cytokine concentrations for (20A) IL-2 (20B) IFNγ and (20C) TNFα following cocultures with OVCAR-3 or OVCAR3-OKT3 cell lines are shown. Non-treated T cells were used as a control. The results represent 1-3 biological replicates with 3 technical replicates each.

Figures 21A, 21B, 21C:
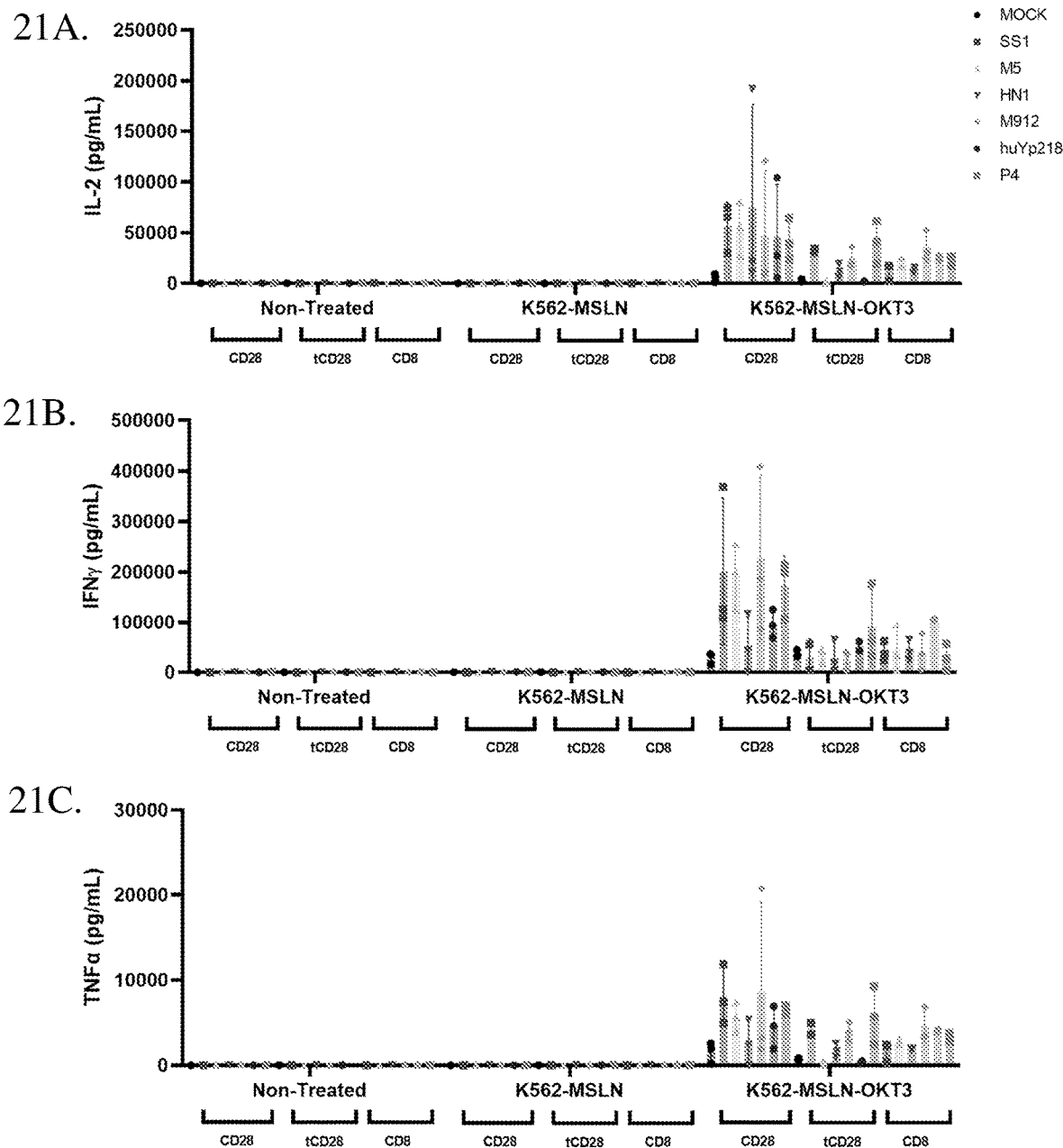

FIG. 21A-21C depicts cytokine expression in healthy donor (HD) T cells transduced with anti-MSLN CoStARs and cocultured with K562 cell lines. CoStARs comprising combinations of six different anti-MSLN scFvs (SS1, M5, HN1, M912, huYP218, P4) and three different spacer/transmembrane domains (CD28, N-terminal truncated CD28, CD8) were compared. Structural details are provided in Table 8, Table 9, and Table 10. Cytokine concentrations for (21A) IL-2 (21B) IFNγ and (21C) TNFα following cocultures with K562-MSNL or K562-MSNL-OKT3 cell lines are shown. Non-treated T cells were used as a control. The results represent 1-3 biological replicates with 3 technical replicates each.

Figure 22:
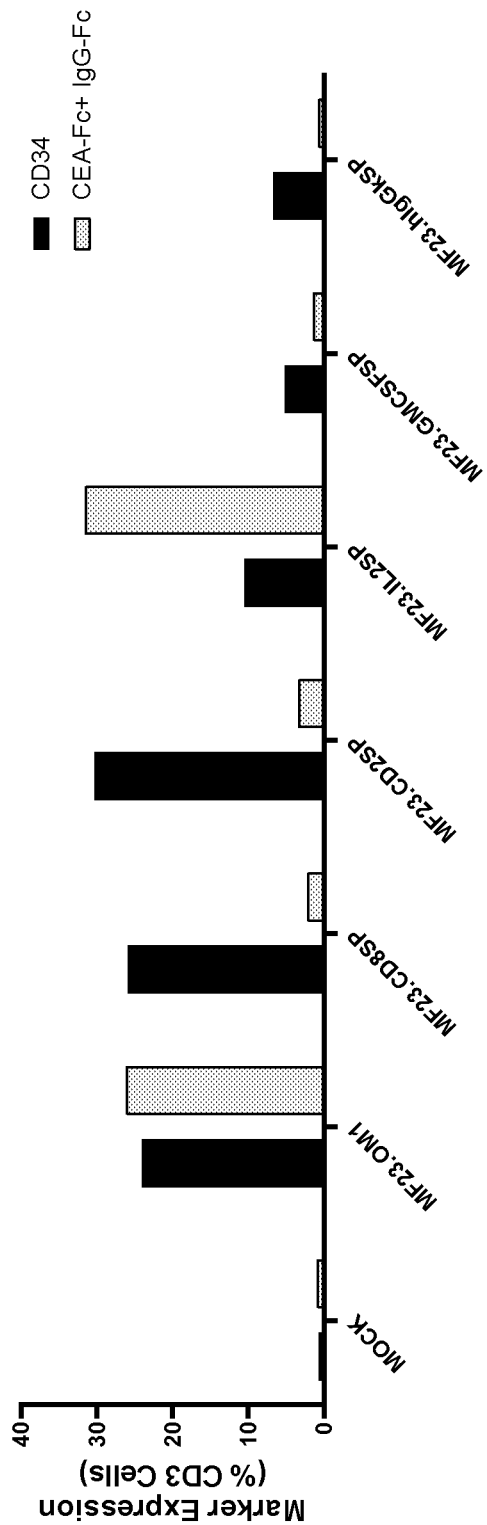

FIG. 22 depicts surface expression of MFE23 scFV anti-CEA CoStARs expressed with six different secretion signal peptides (OSM1, CD8, CD2, IL2, GMCSF, hIgGκ). Structural details are provided in Table 11. Following expansion, cells were assessed for transduction efficiency either via surface detection of the marker gene truncated CD34 (tCD34) or CoStAR molecule using an anti-CD34-APC (black bars) or using a primary rhCEACAM5-Fc antibody with a secondary anti-IgG-Fc-PE (grey bars) antibody, respectively.

Figure 23:
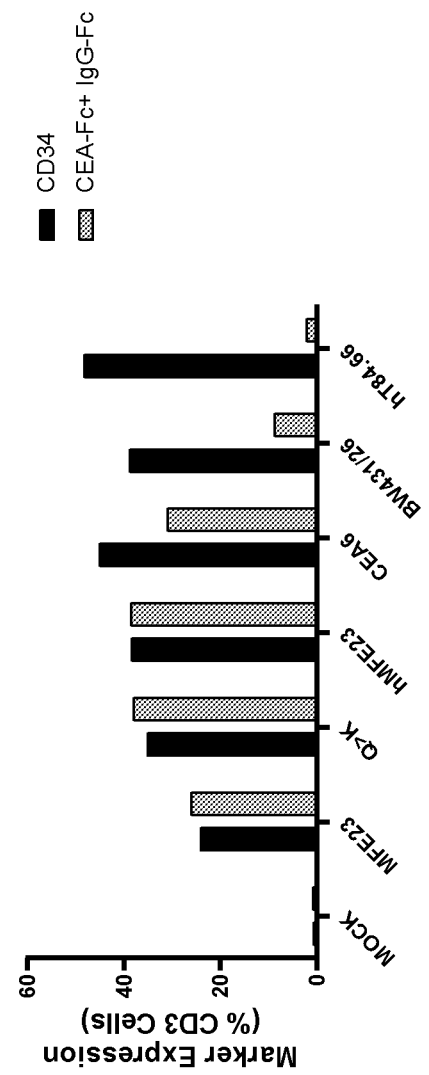

FIG. 23 depicts surface expression of CoStARs comprising six different anti-CEA scFvs (MFE23, MFE23(Q>K), hMFE23, CEA6, BW431/26, hT84.66). Structural details are provided in Table 12. Following expansion, cells were assessed for transduction efficiency either via surface detection of the marker gene truncated CD34 (tCD34) or CoStAR molecule using an anti-CD34-APC (black bars) or using a primary rhCEACAM5-Fc antibody with a secondary anti-IgG-Fc-PE (grey bars) antibody, respectively.

Figure 24A:
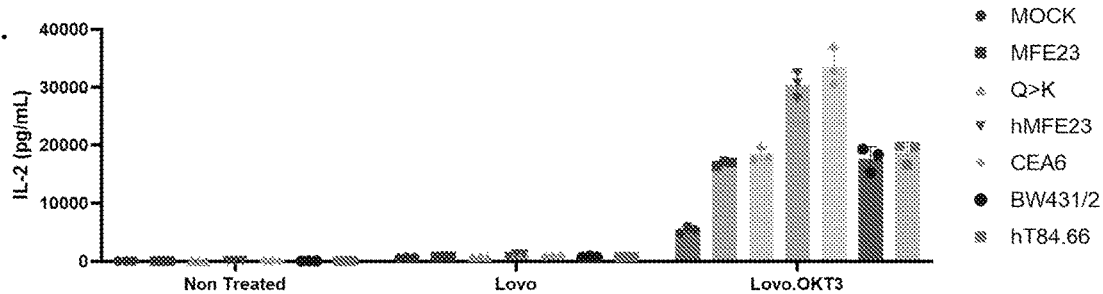
Figure 24B:
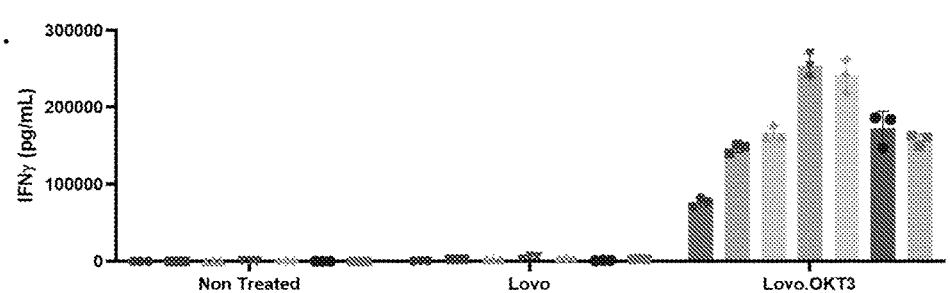
Figure 24C:
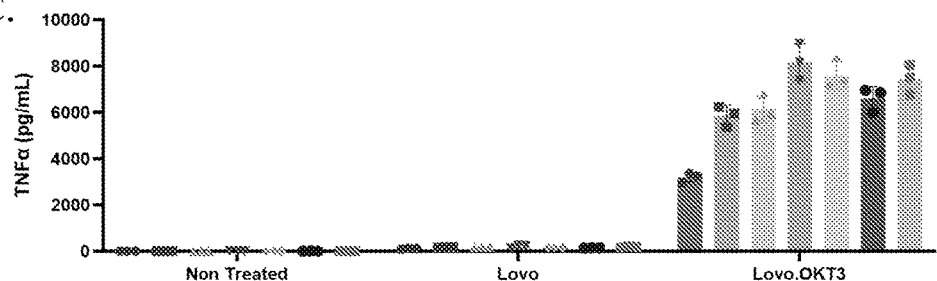

FIG. 24A-24C depicts cytokine production by healthy donor (HD) T cells transduced with anti-CEA CoStARs (MFE23, MFE23(Q>K), hMFE23, CEA6, BW431/26, hT84.66) and cocultured with LoVo cell lines. Structural details are provided in Table 12. Cytokine concentrations are shown for (24A) IL-2 (24B) IFNγ and (24C) TNFα following cocultures with Lovo or Lovo-OKT3 cell lines. Non-treated T cells were used as a negative control.

Figures 25A, 25B, 25C:
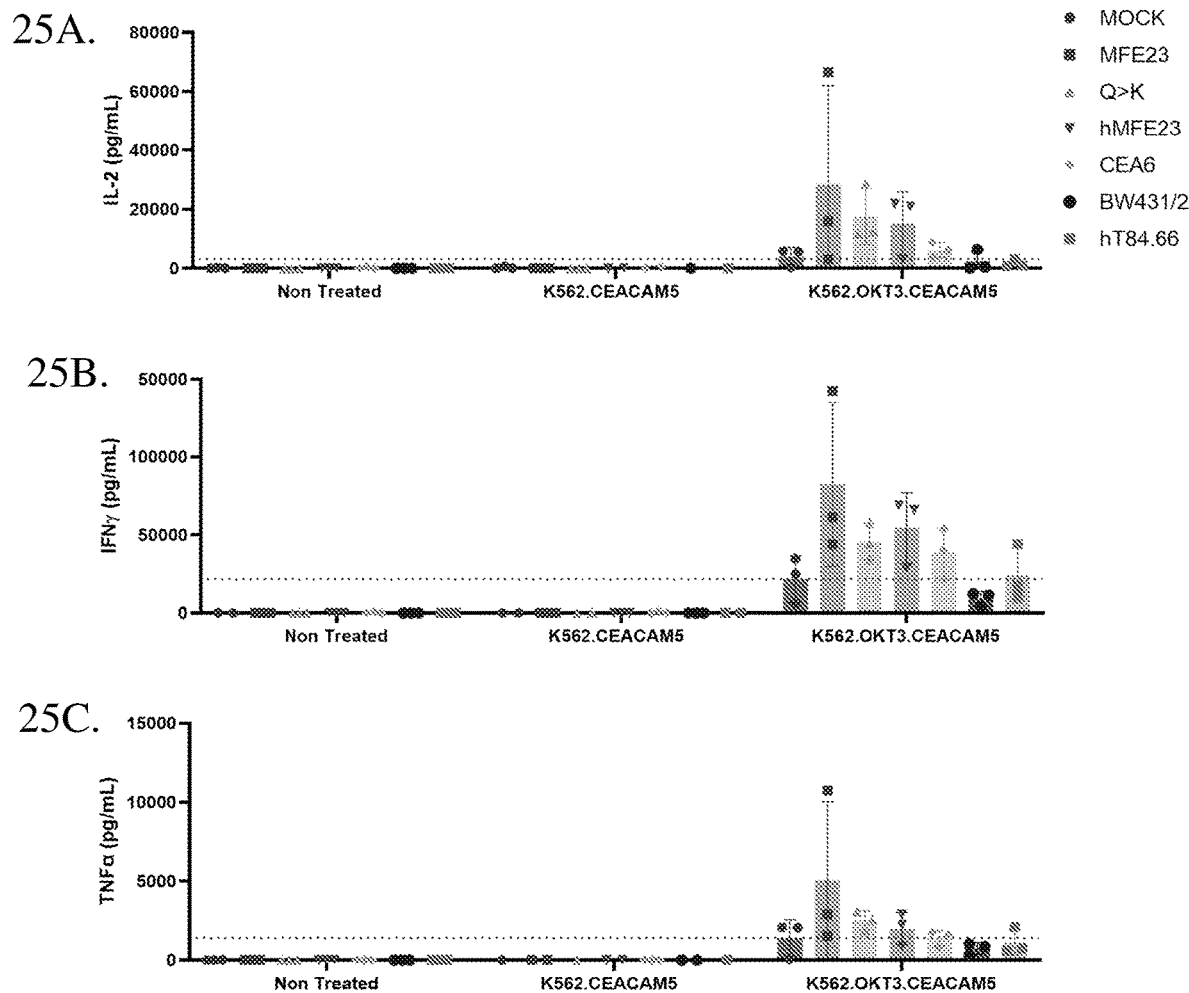

FIG. 25A-25C depicts cytokine production in healthy donor (HD) T cells transduced with anti-CEA CoStARs (MFE23, MFE23(Q>K), hMFE23, CEA6, BW431/26, hT84.66) and cocultured with K562 cell lines. Cytokine concentrations are shown for (25A) IL-2 (25B) IFN' and (25C) TNFα following cocultures with K562.CEACAM5 (signal 2) or K562.CEACAM5.OKT3 (signal 1+2) cell lines. Non-treated T cells were used as a negative control.

Figure 26:
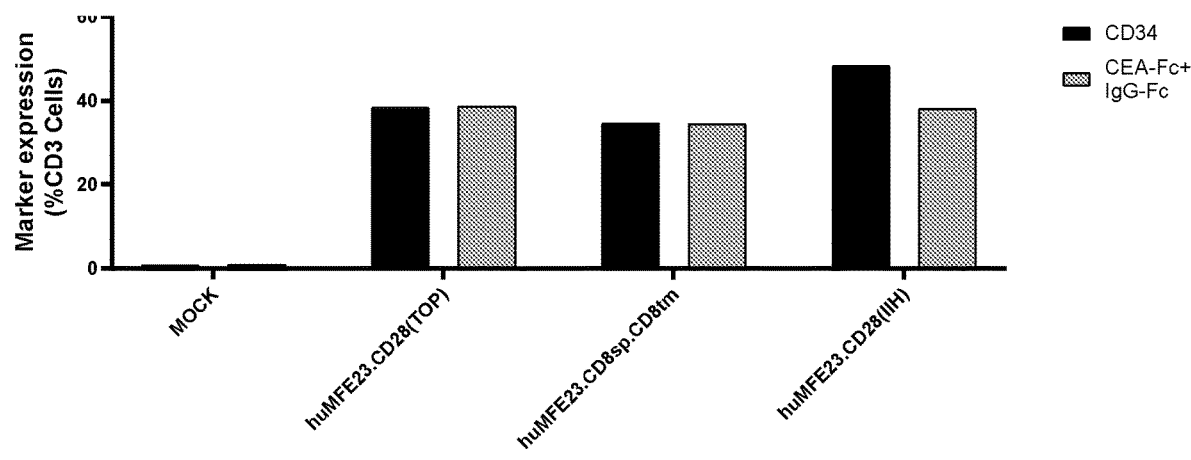

FIG. 26 depicts surface expression of hMFE23 scFV anti-CEA CoStARs expressed with three different spacer/transmembrane domains. Structural details are provided in Table 13. Following expansion, cells were assessed for transduction efficiency via surface detection of the marker gene truncated CD34 (tCD34) using an anti-CD34-APC (black bars) or the CoStAR molecule using a primary rhCEACAM5-Fc antibody with a secondary anti-IgG-Fc-PE antibody (grey bars).

Figures 27A, 27B, 27C:
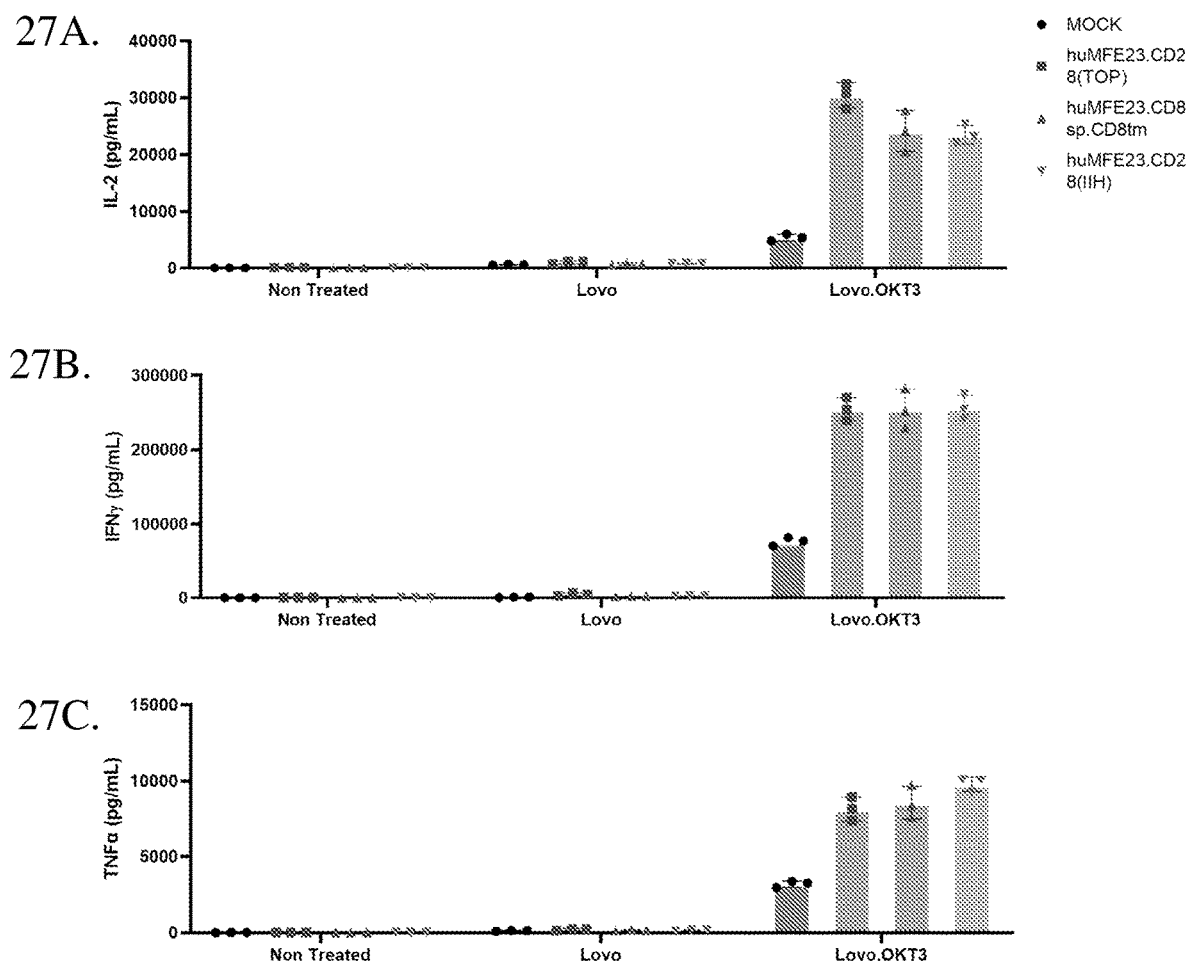

FIG. 27A-27C depicts cytokine production by the MFE23 scFV anti-CEA spacer variants. Cytokine concentrations for (27A) IL-2 (27B) IFNγ and (27C) TNFα following cocultures with Lovo or Lovo.OKT3 cell lines are shown. Non-treated T cells were used as a control.

Figure 28:
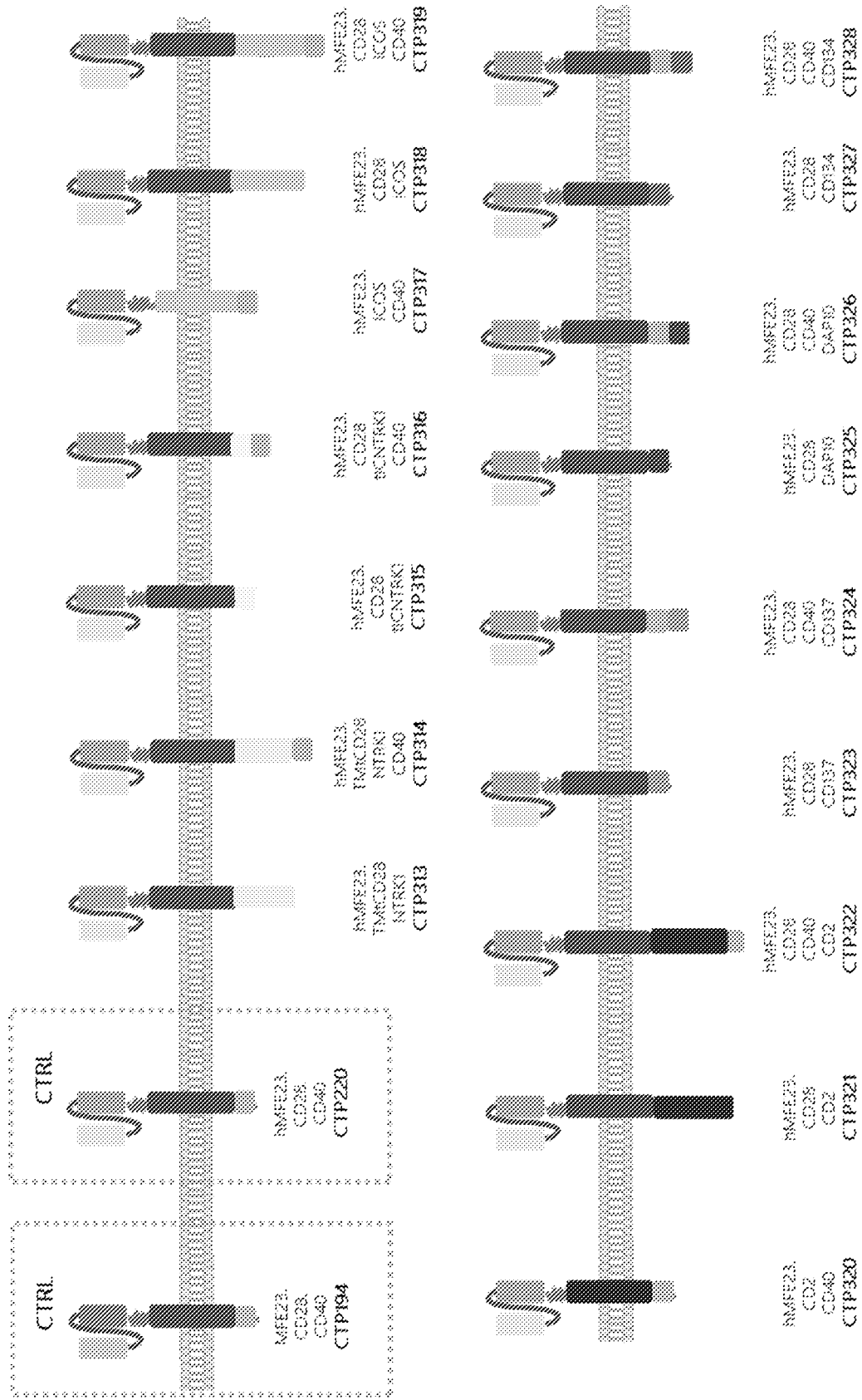

FIG. 28 depicts anti-CEA CoStARs comprising an hMFE23 CEA-binding domain with intracellular signalling domains comprising CD40, CD134, CD137, CD2, ICOS, DAP10 and NTRK1 signaling elements.

Figure 29:
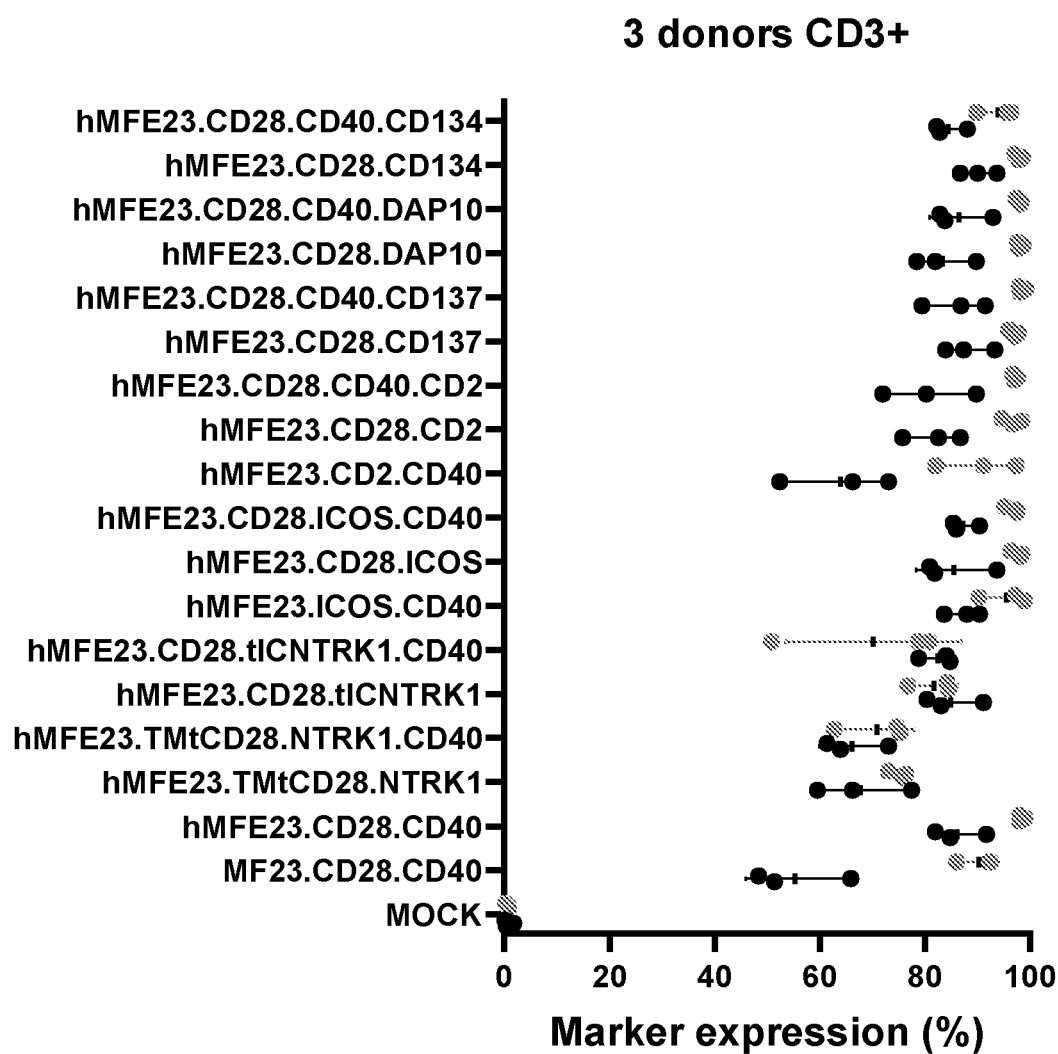

FIG. 29 depicts surface expression of hMFE23 scFV anti-CEA CoStARs comprising domain combinations depicted in FIG. 28 and detail in Table 14. Following expansion, cells were assessed for transduction efficiency via surface detection of the marker gene truncated CD34 (tCD34) using an anti-CD34-APC (black circles) or the CoStAR molecule using a primary rhCEACAM5-Fc antibody with a secondary anti-IgG-Fc-PE antibody (red circles). The results represent three biological replicates.

Figure 30:
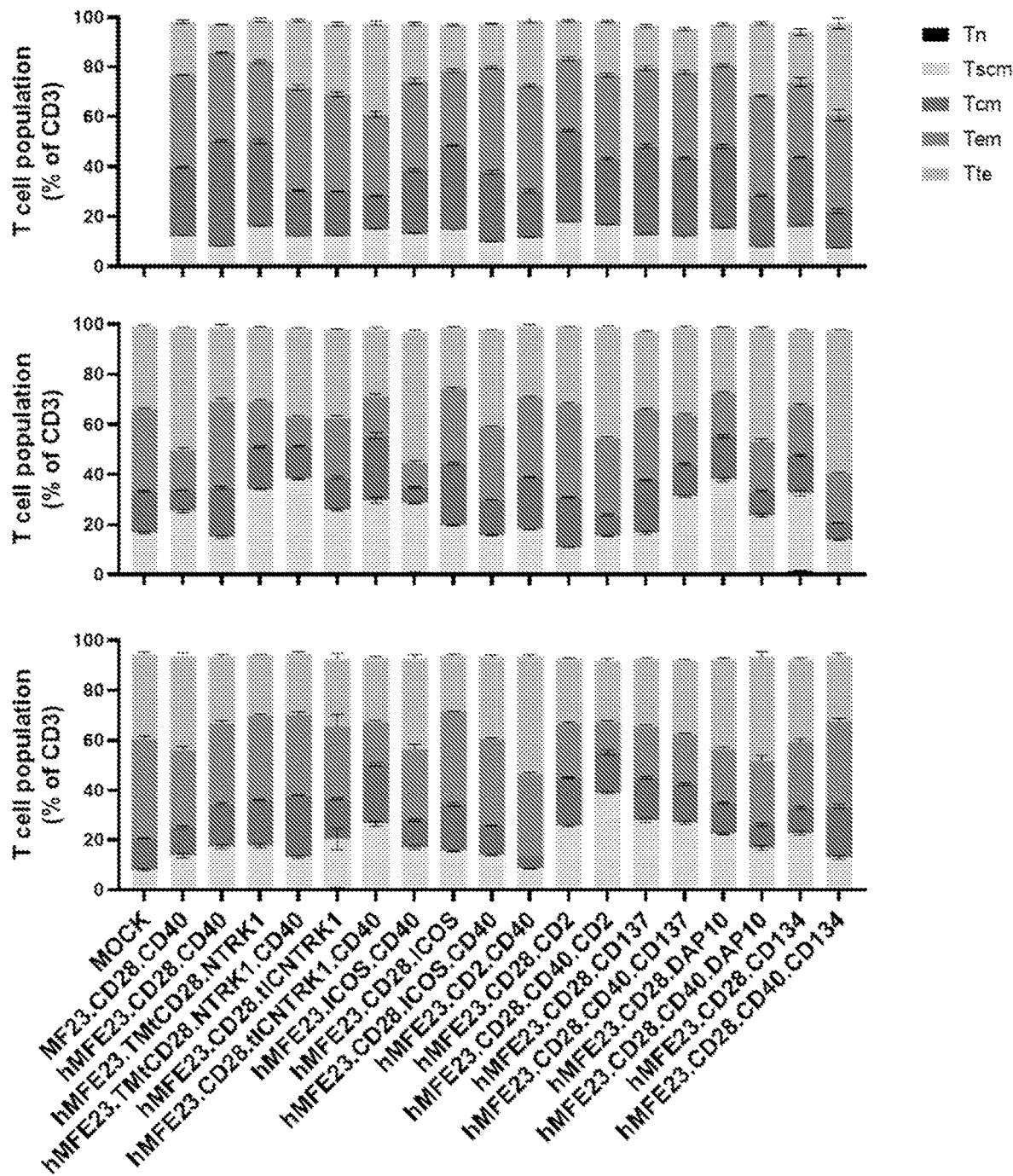

FIG. 30 depicts T cell phenotypes of CoStAR transfected HD T cells in three separate donors. Cells were sorted using CD34 microbeads and underwent a rapid expansion protocol (REP) for 14 days. Following outgrowth and REP, $1 \times 10^5$ cells were assessed for the differentiation subtype using flow cytometry. Tcm, central memory T cell; Tem, effector memory T cell; Tn, naïve T cell; Tscm; stem cell memory T cell; Tte, terminal effector T cell. See Table 15 for T cell subtype definitions.

Figure 31A:
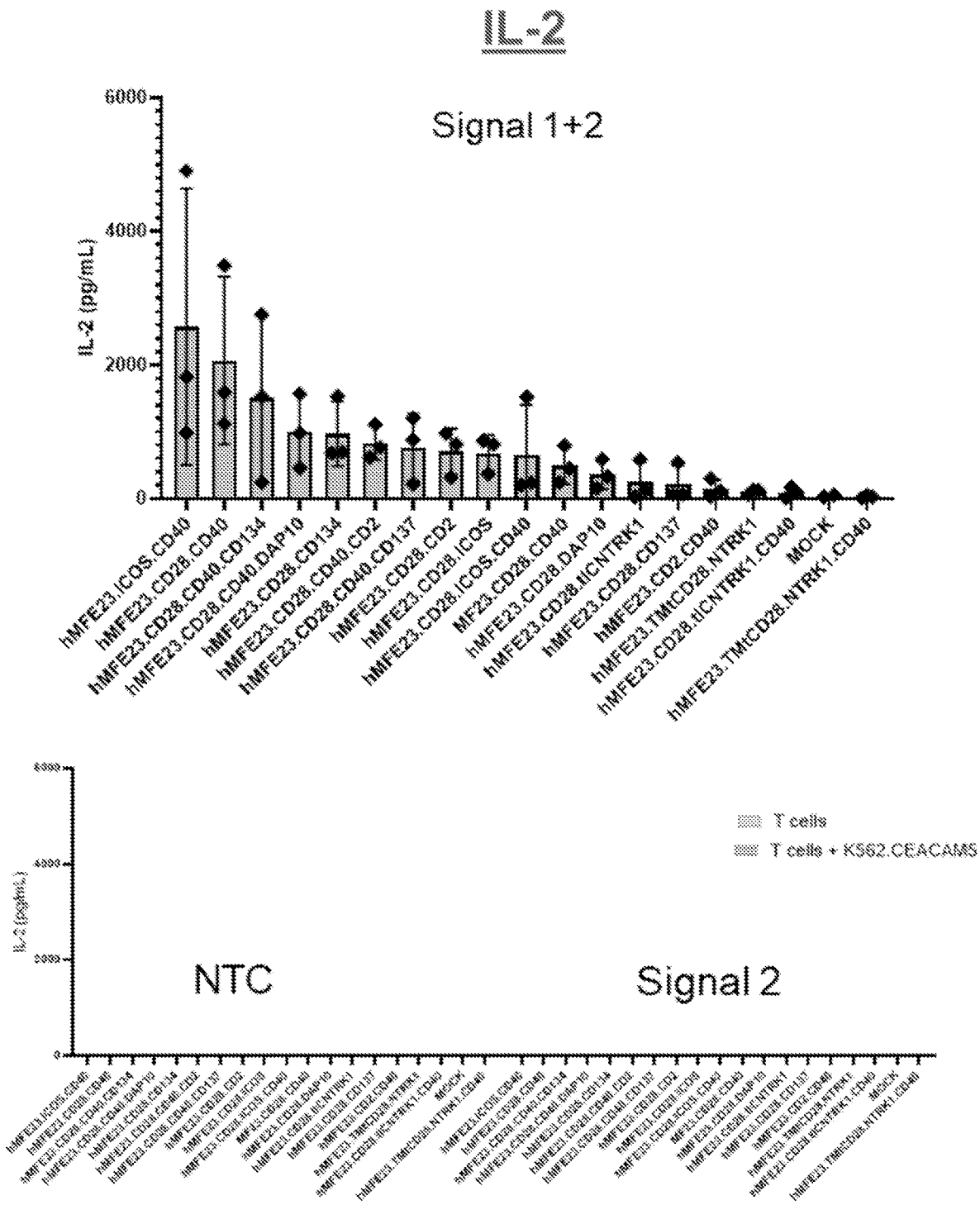
Figure 31B:
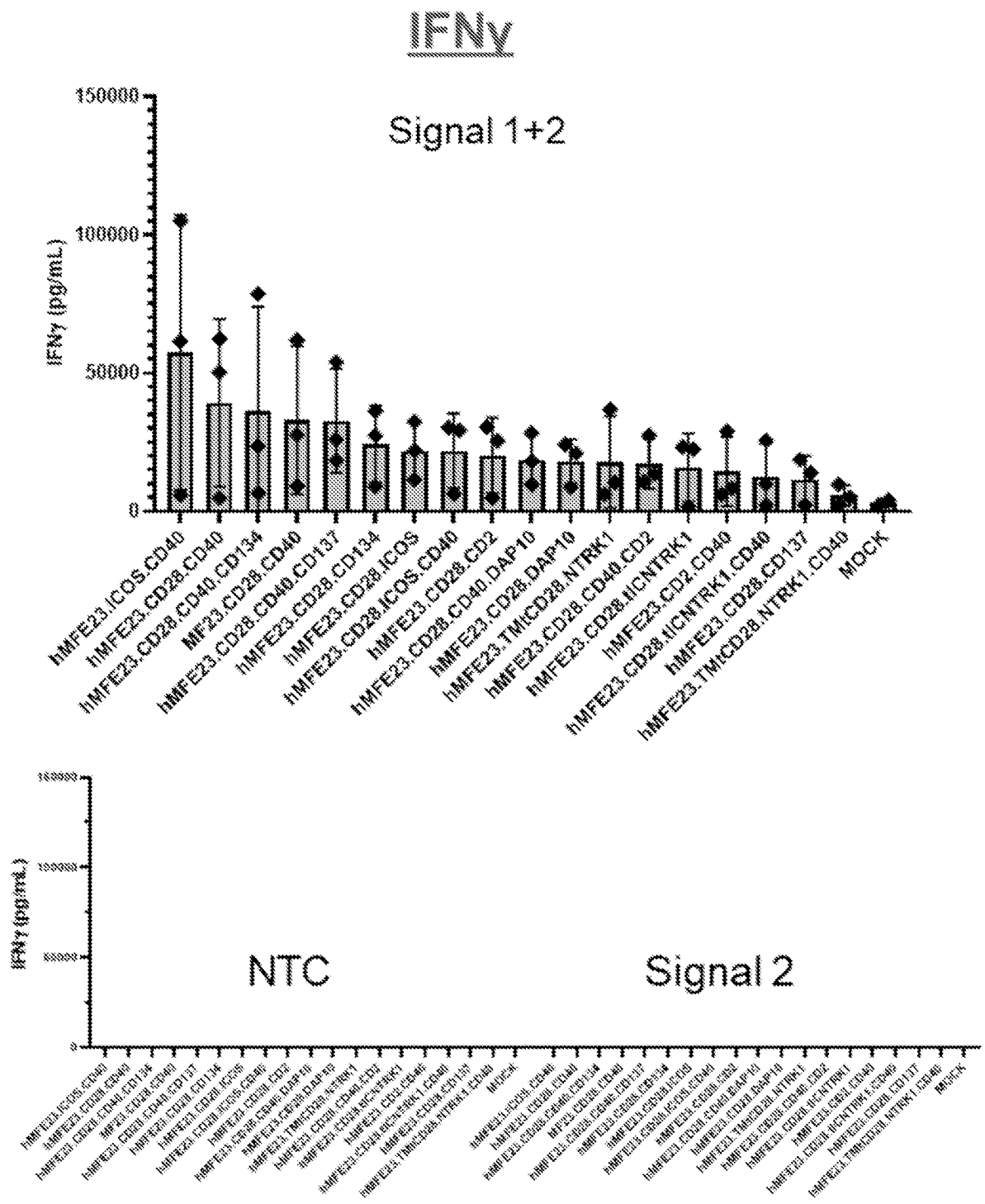
Figure 31C:
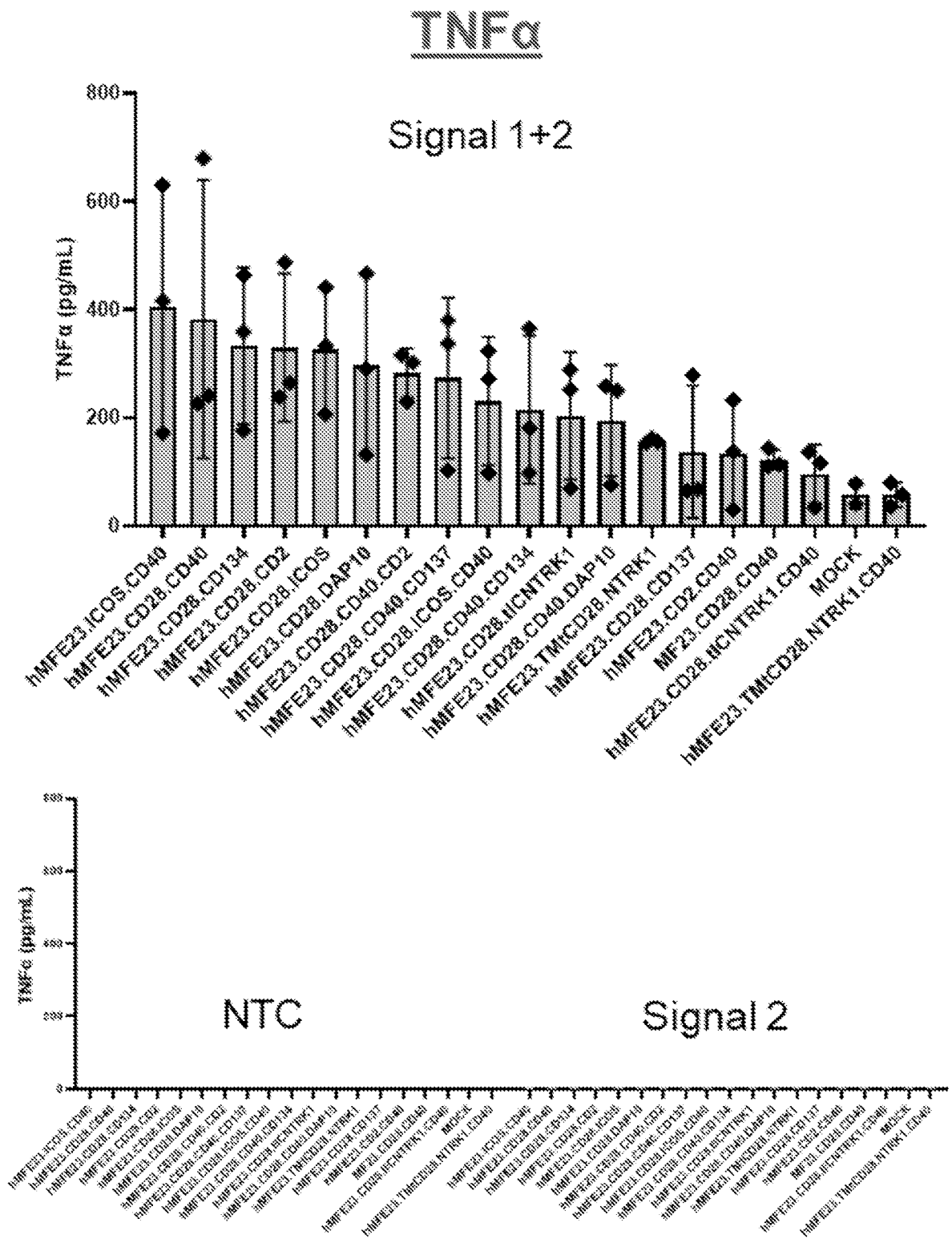

FIG. 31A-31C depicts cytokine production by hMFE23 scFV anti-CEA CoStAR transduced HD T cells cocultured with K562 cell lines. Cytokine concentrations for (31A) IL-2, (31B) IFNγ, and (31C) TNFα are shown following cocultures with K562.CEACAM5 (signal 2) or K562.CEACAM5.OKT3 (signal 1+2) cell lines. Non-treated T cells were used as a control.

Figure 32A:
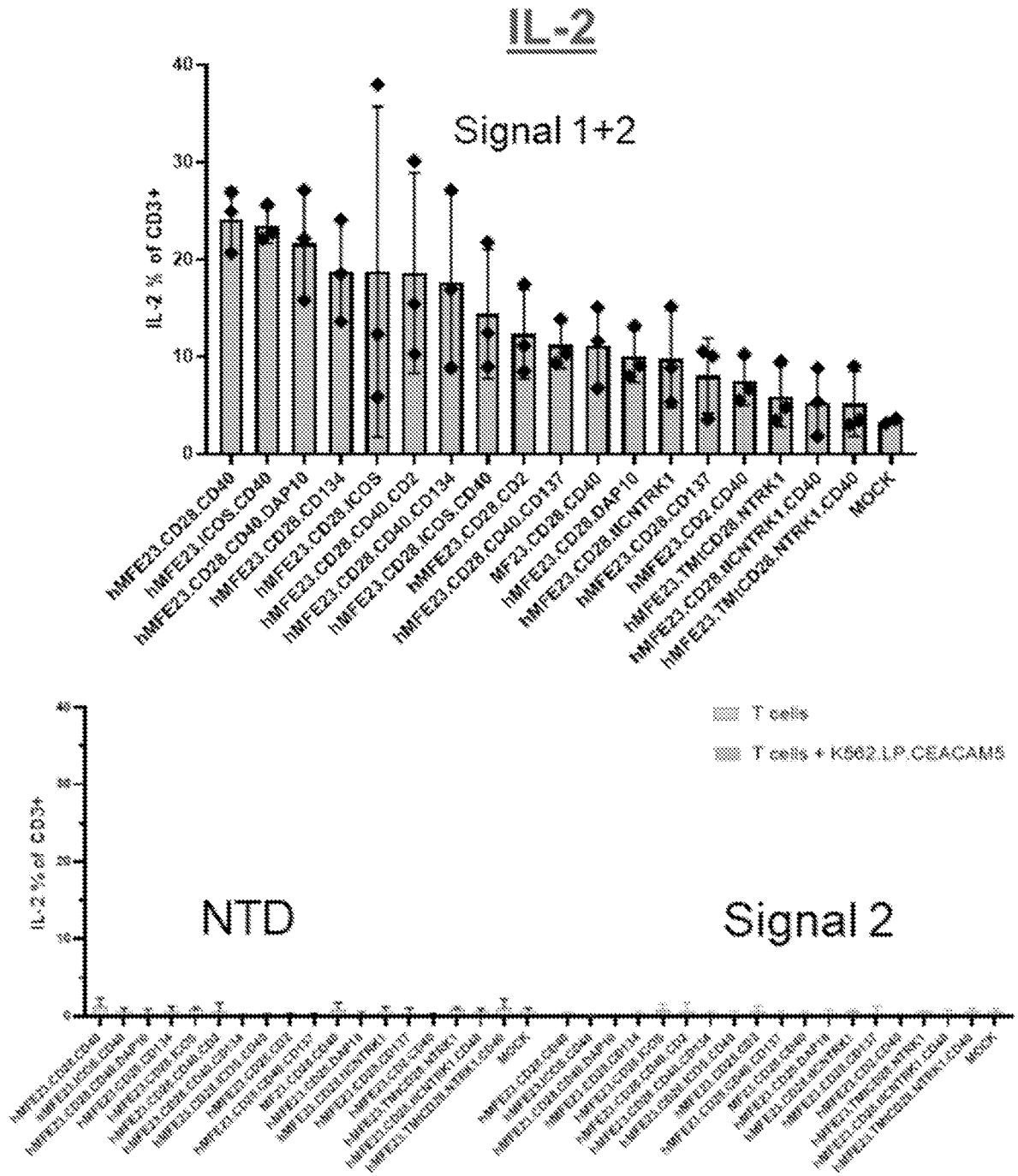
Figure 32B:
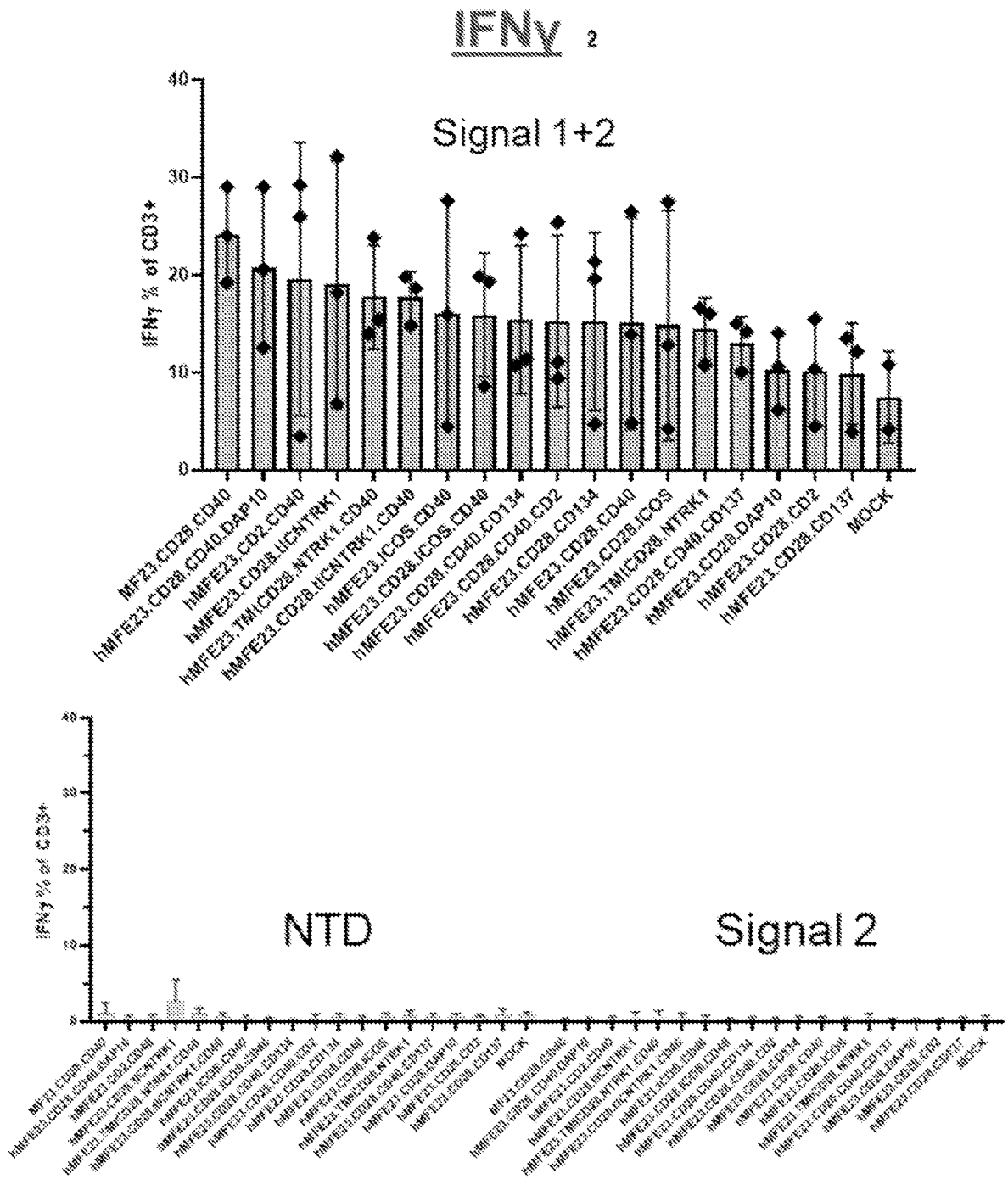
Figure 32C:
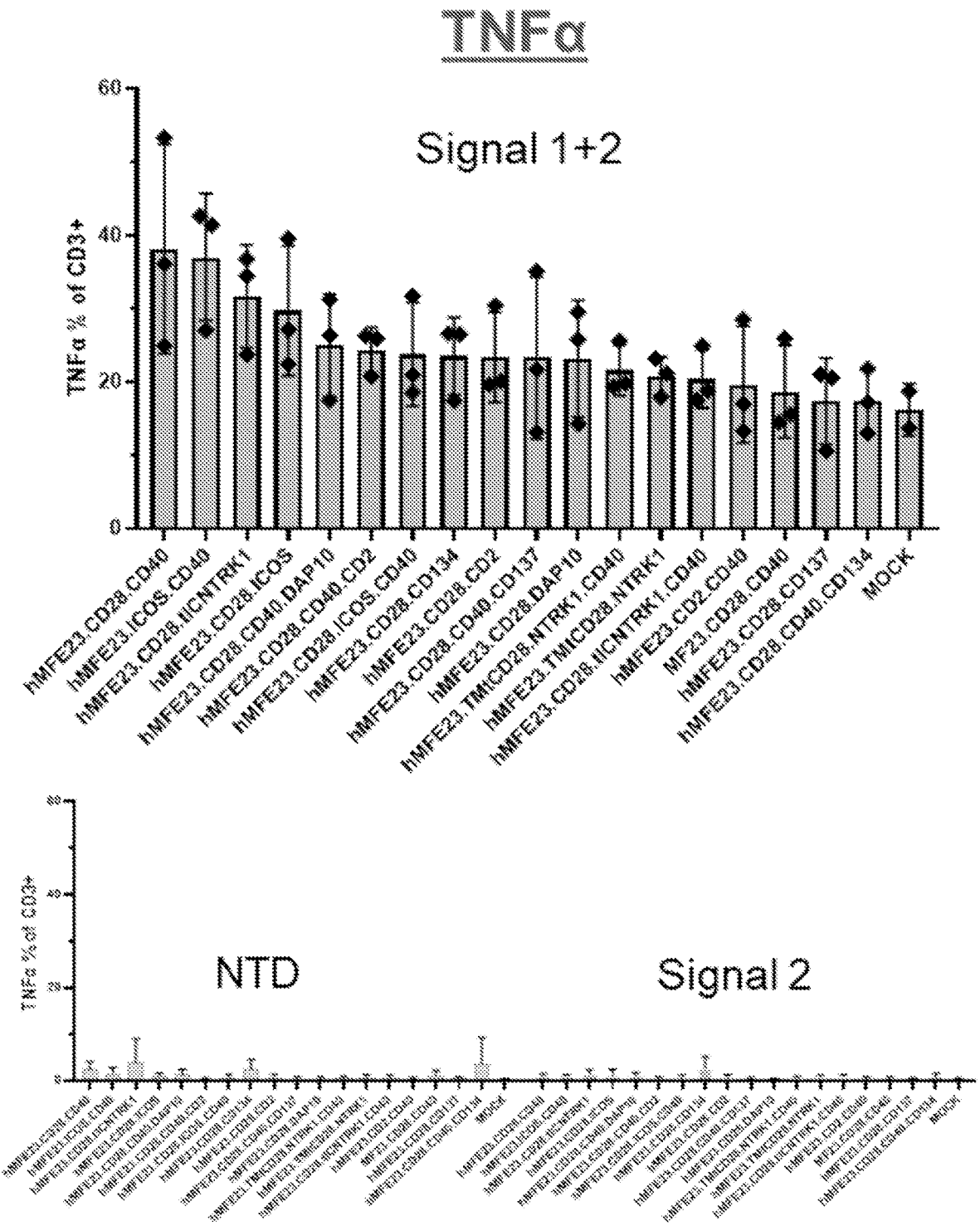

FIG. 32A-32C depicts cytokine expression in HD T cells transduced with hMFE23 scFV anti-MSLN CoStARs and cocultured with K562 cell lines. Frequency of (32A) IL-2, (32B) IFNγ, and (32C) TNFα expressing cells is shown following cocultures with K562.CEACAM5 (signal 2) or K562.CEACAM5.OKT3 (signal 1+2) cell lines. Non-treated T cells were used as a control.

Figure 33:
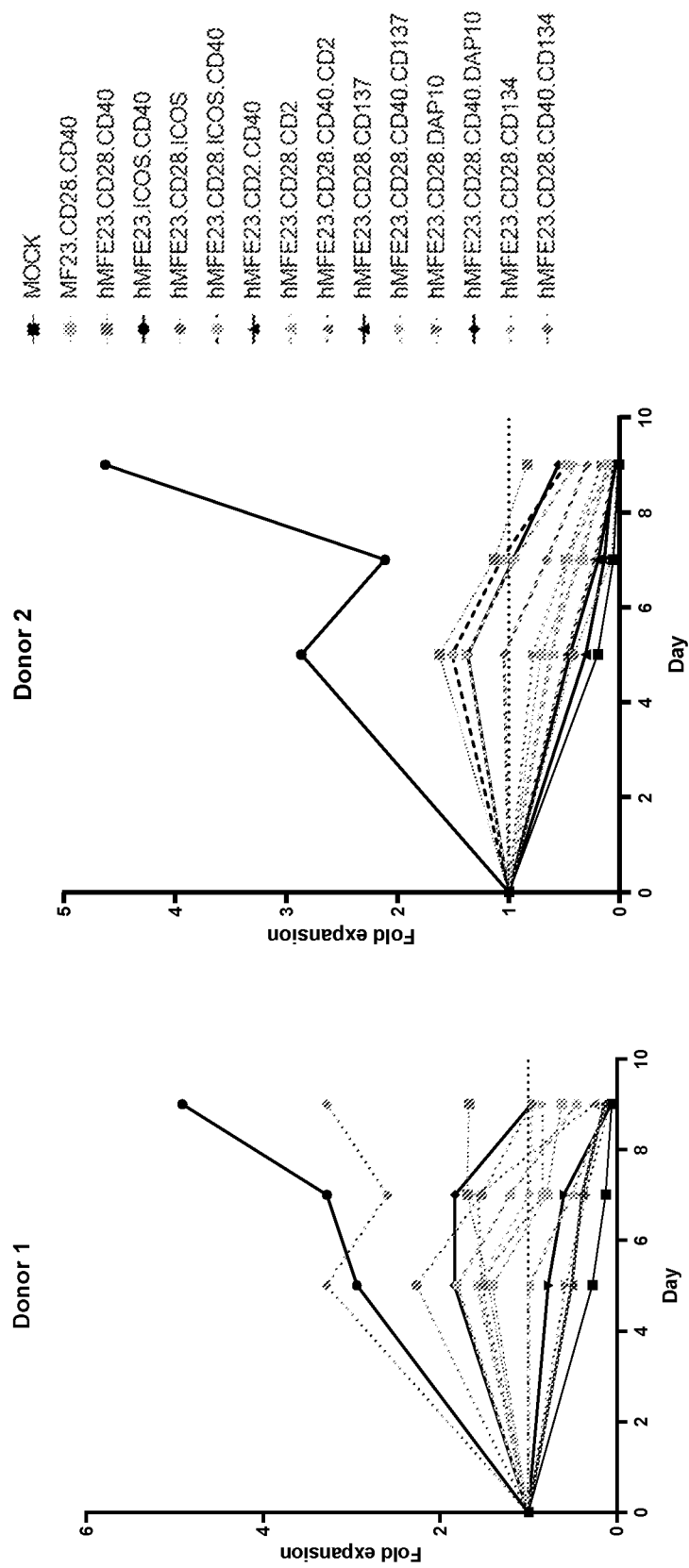

FIG. 33 depicts proliferation of HD T cells from transduced with hMFE23 scFV anti-MSLN CoStARs cocultured with K562.CEACAM5.OKT3 (signal 1+2) cell lines. HD T cells were procured from two donors. The figures represent fold expansion of input cells.

Figure 34:
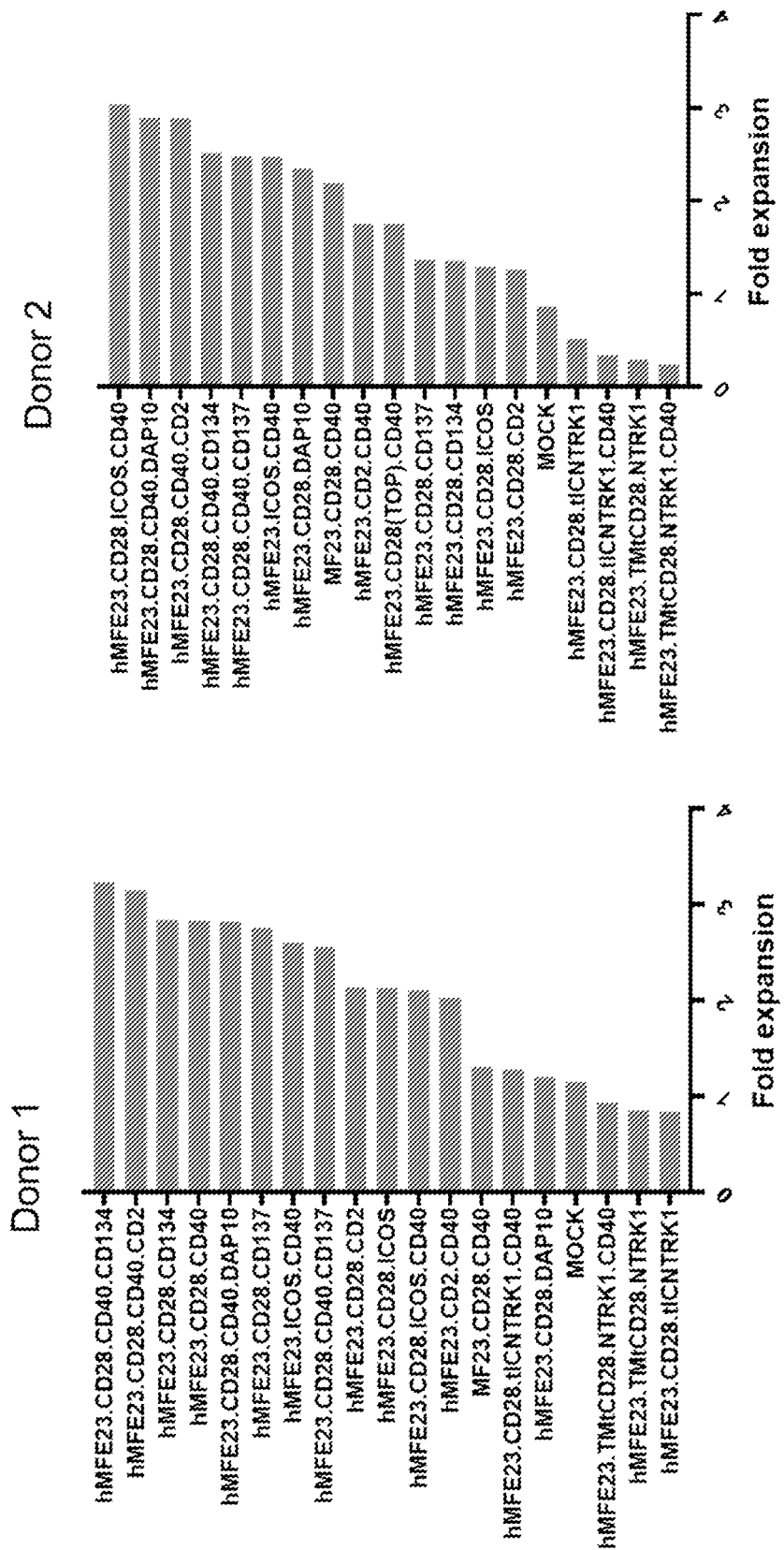

FIG. 34 depicts proliferation of HD T cells from transduced with hMFE23 scFV anti-MSLN CoStARs cocultured with K562.CEACAM5.OKT3 (signal 1+2) cell lines. HD T cells were procured from two donors. The figures represent fold expansion of input cells on Day 6 post stimulation.

Figure 35A:
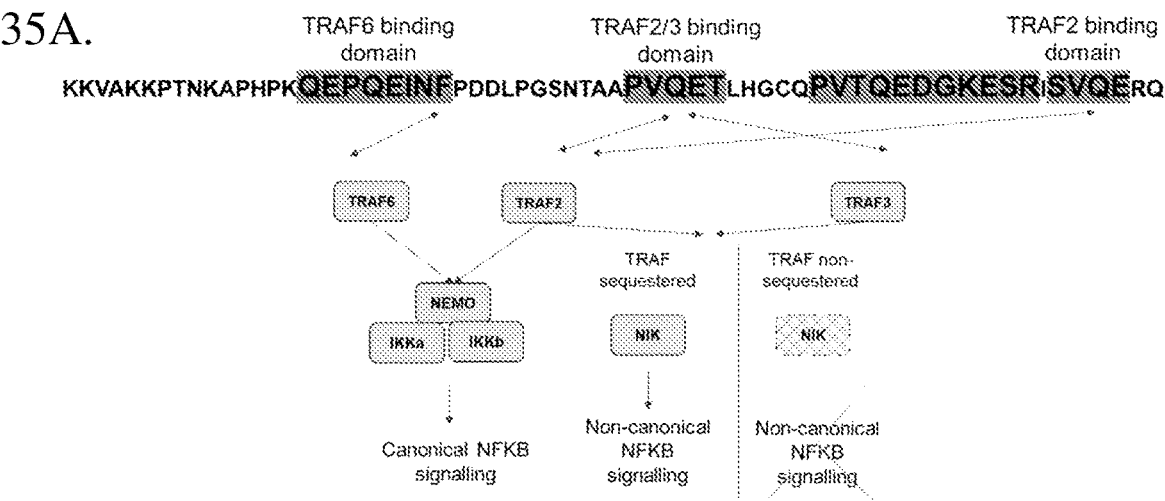
Figure 35B:
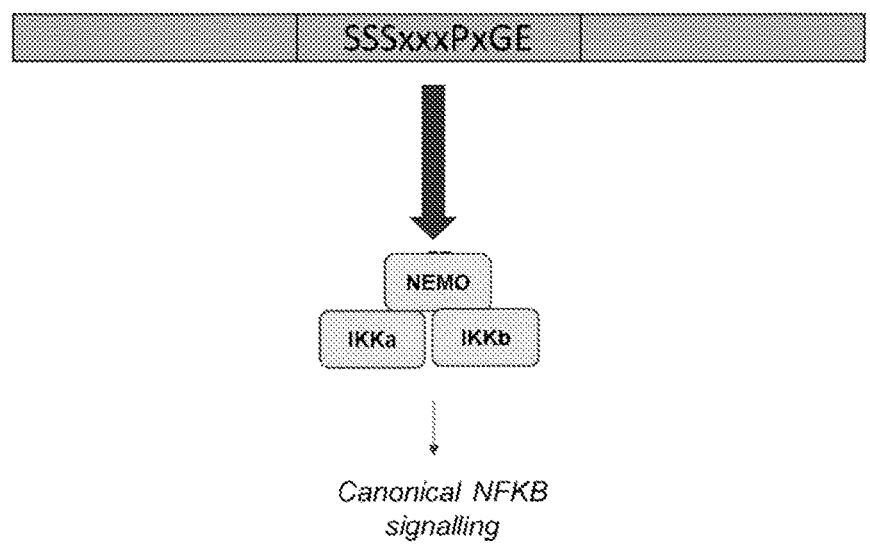

FIG. 35A-35B depicts TRAF and TRAF-like binding sites and motifs and signalling pathways. 35A. CoStAR CD40 intracellular domain showing TRAF binding sites and signalling. 35B. CoStAR comprising an IProx domain.

Figure 36A:
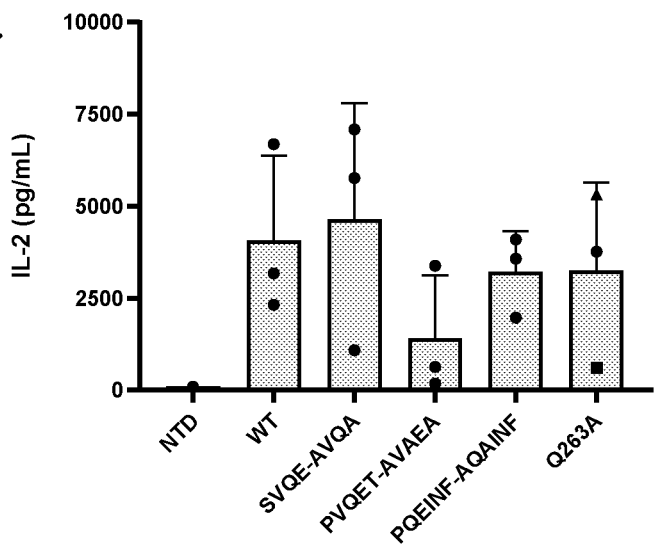
Figure 36B:
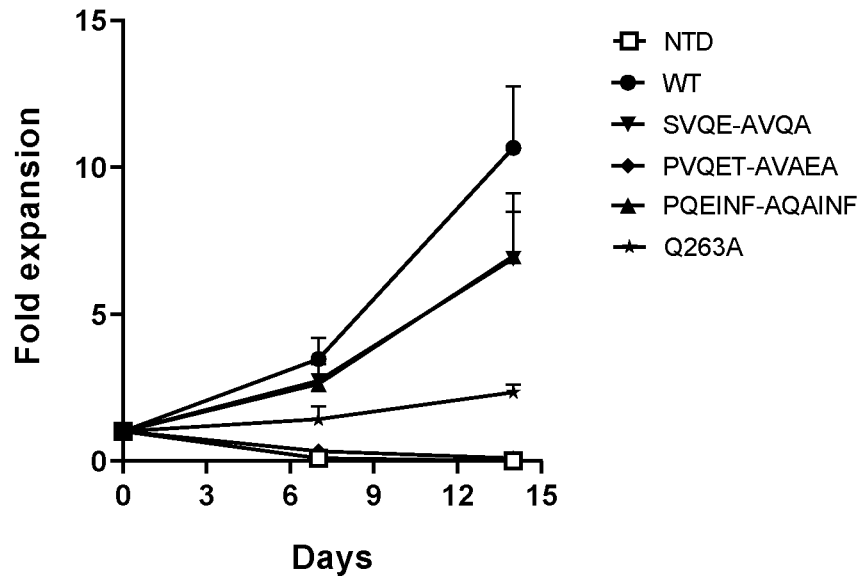

FIG. 36A-36B depicts the effect of mutations in CoStAR CD40 intracellular signaling domain on cytokine secretion and long term survival and proliferation of CD28.CD40 CoStAR transduced T cells cocultured with LoVo.OKT3. Cells of three donors were activated with Dynabeads and transduced with WT CD28.CD40 (CTP194), CD28.CD40 containing TRAF2 binding site mutation SVQE>AVQA (CTP195), TRAF2/TRAF3 binding site mutation PVQET>AVAEA (CTP196), TRAF6 binding site mutation PQEINF>AQAINF (CTP197), Q263A (CTP199), or mock transduced. (36A) IL-2 was measured in supernatants collected 24 hours after coculture in absence of IL-2 with LoVo or LoVo.OKT3.GFP tumor cells. (36B) Viability and absolute count were assessed after 6-8 days and live T cells were rechallenged for an additional week with fresh LoVo.OKT3.GFP tumor cells. At the end of the long-term coculture, the viability and absolute count were measured, and the fold expansion was calculated. Data shown as mean+/−SEM of n≤3 donors analysed in triplicates.

FIG. 37A-37B depicts percentage of TIL (37A) and total TIL counts (37B) based on CD2+ stain in thawed OC samples at day 1.

FIG. 38 depicts growth of non-Td and Td TILs. Cells were counted using CD2 and DRAQ7 staining and acquisition on the Novocyte 3005. Cell counts at the end of REP on day 25 are graphically represented. Shapes corresponding to the each of the 5 ovarian cancer samples are depicted. Filled shapes are Non-Td and open shapes are Td TILs. Statistical analysis was performed using a paired t-test.

FIG. 39A-39D depicts transduction efficiency and viral integrations per cell of CoStAR modified TILs. Nontransduced (Non-Td) and anti-FOLR1 CoStAR transduced (Td) TILs were assessed for the transduction efficiency on day 25 post REP in the CD3+(39A), CD4+(39B) and CD8+(39C) cell populations. The viral copy number (VCN) was assesed to determine viral integrations (39D). Shapes corresponding to the each of the 5 ovarian cancer samples are depicted. Filled shapes are non-Td and clear shapes are Td TILs.

Figure 40:
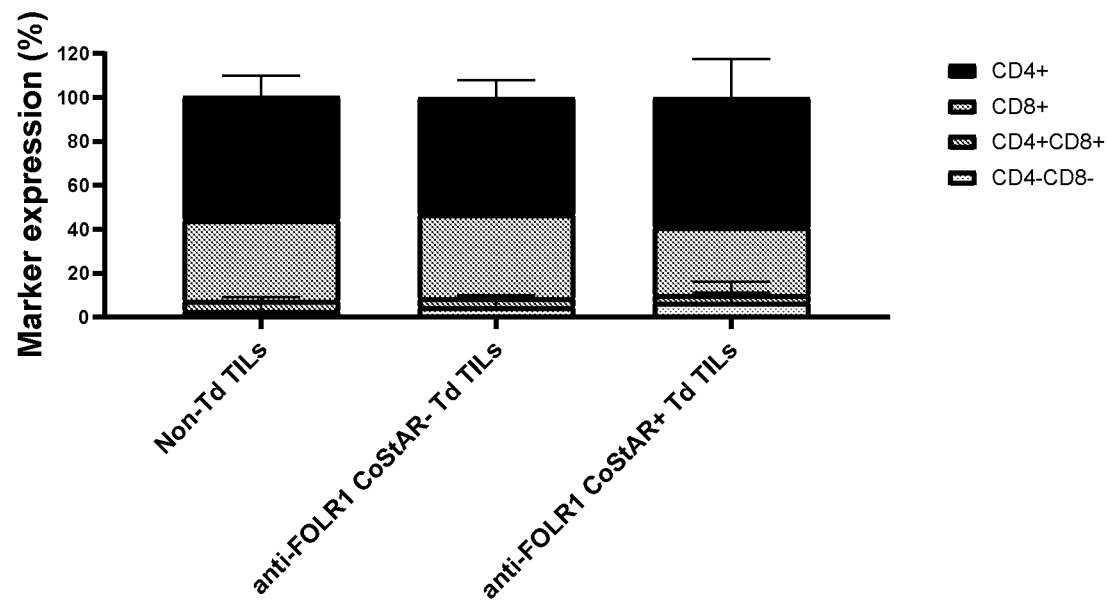

FIG. 40 depicts CD4 and CD8 populations in post-REP TILs. Nontransduced (Non-Td) and anti-FOLR1 CoStAR-transduced (Td) and anti-FOLR1 CoStAR+Td TILs were assessed for the CD4 and CD8 composition on D25 post-REP using flow cytometry. Statistical analysis was performed using a two-way ANOVA with matched Tukey's multiple comparisons post-test.

Figure 41A:
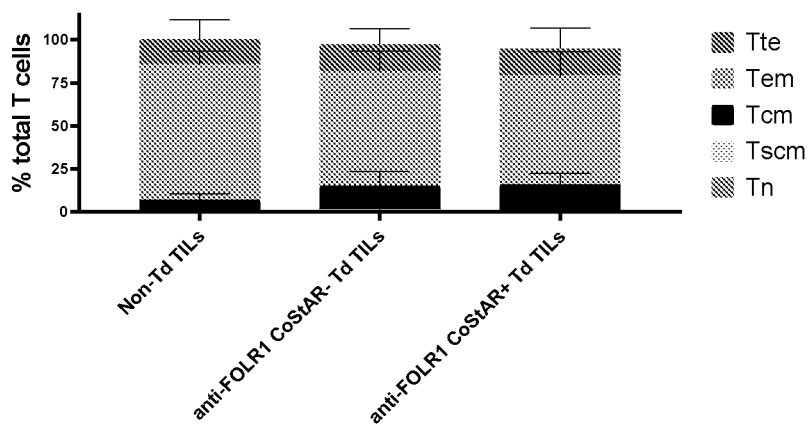
Figure 41B:
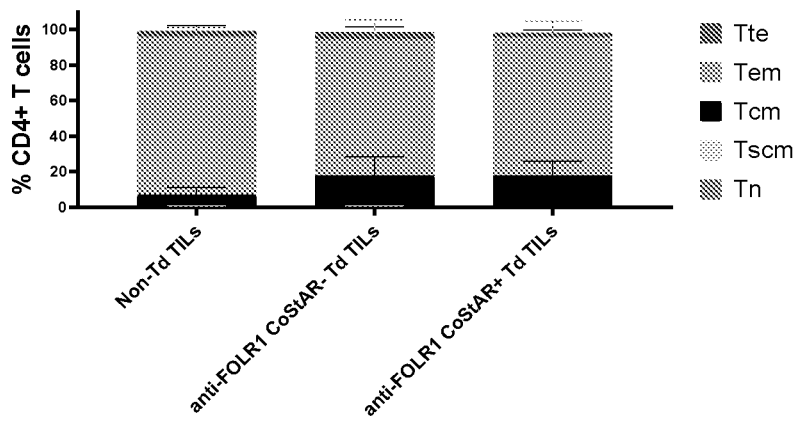
Figure 41C:
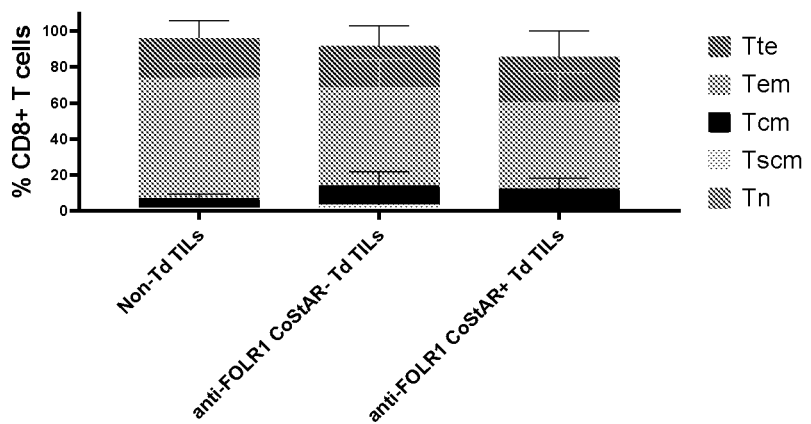

FIG. 41A-41C depicts the effect of CoStAR modification on the differentiation status of TILs. Nontransduced (Non-Td), anti-FOLR1 CoStAR− transduced (Td) TILs and anti-FOLR1 CoStAR+Td TILs were assessed for their differentiation status on D25 post-REP from total T cell (41A), CD4+(41B) and CD8+(41C) cell populations. Statistical analysis was performed using a two-way ANOVA with matched Tukey's multiple comparisons test. Statistical significance was observed for the Tscm population between the anti-FORL1 CoStAR− Td TILs and anti-FOLR1 CoStAR+Td TILs for CD3+(A) and CD4+(B) populations. *p≤0.05

Figure 42A:
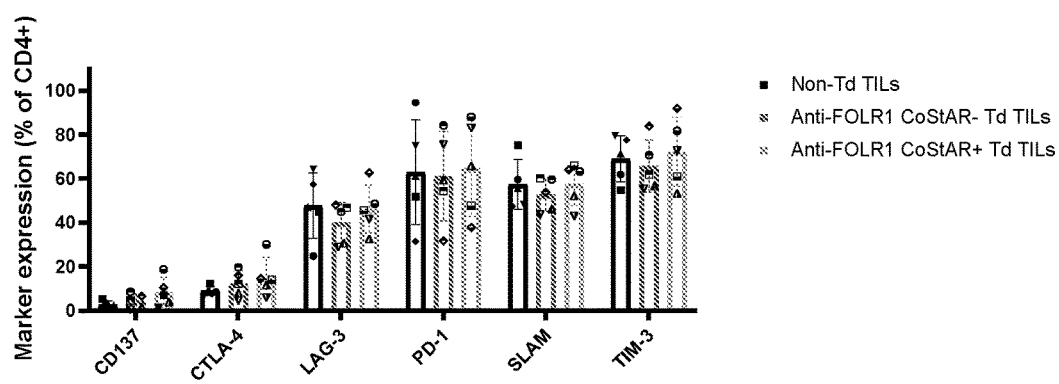
Figure 42B:
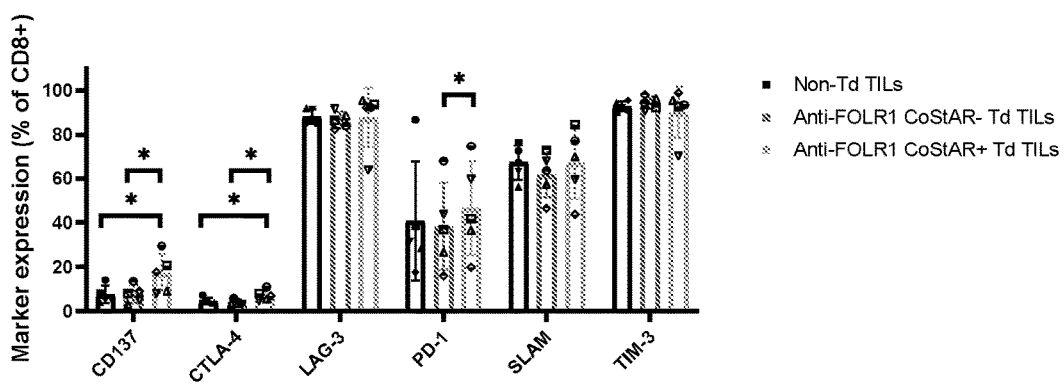

FIG. 42A-42B depicts effects of CoStAR modification of TILs on co-inhibitory or co-stimulatory marker expression. Nontransduced (Non-Td), anti-FOLR1 CoStAR-transduced (Td) TILs and anti-FOLR1 CoStAR+Td TILs were assessed for the expression of co-inhibitory and co-stumulatory markers in CD4+(42A) and CD8+(42B) cell populations. Shapes corresponding to the each of the 5 ovarian cancer samples are depicted regardless of the filling. Black, dark grey and light grey bars represent Non-Td TILs, anti-FOLR1 CoStAR− Td and anti-FOLR1 CoStAR+Td TILs, respectively. Statistical analysis was performed using a Two-way ANOVA with a matched Tukey's multiple comparisons post-test. *p<0.05

Figure 43A:
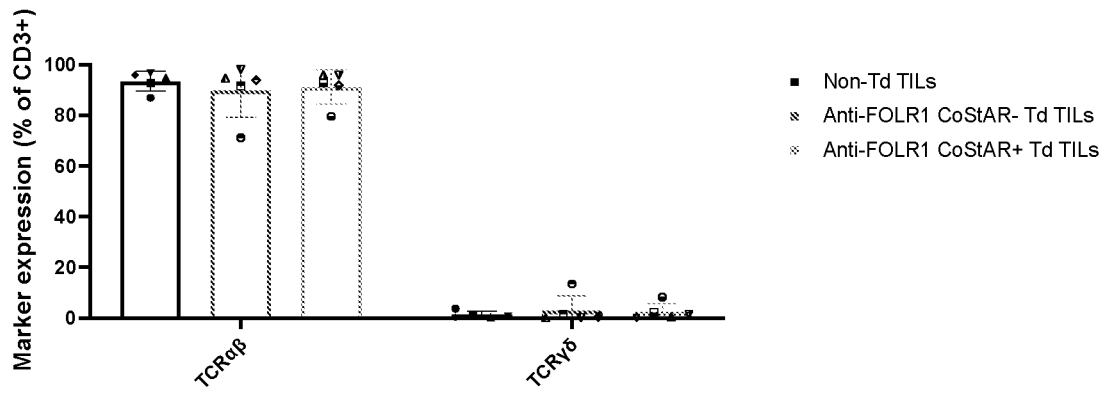
Figure 43B:
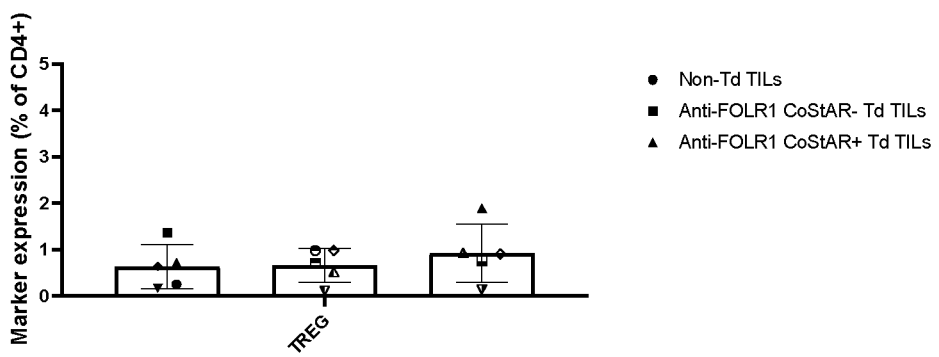

FIG. 43A-43B depicts effects of CoStAR modification on TCRαβ, TCRγδ and Treg frequency in TILs. Nontransduced (Non-Td), anti-FOLR1 CoStAR− transduced (Td) TILs and anti-FOLR1 CoStAR+Td TILs were assessed for the frequency of TCRαβ (CD3+TCRαβ+), and TCRγδ (CD3+TCRγδ+) in CD3+ cell populations (43A). The frequency of Tregs in the CD4+ subpopulation was also assessed (43B). Shapes corresponding to the each of the 5 ovarian cancer samples are depicted regardless of the filling. Black, dark grey and light grey bars represent Non-Td TILs, anti-FOLR1 CoStAR− Td TILs and anti-FOLR1 CoStAR+Td TILs, respectively. Statistical analysis was performed using a two-way ANOVA with matched Tukey's multiple comparisons post-test (43A) and a one-way ANOVA with a Friedman's post-test (43B).

Figure 44A:
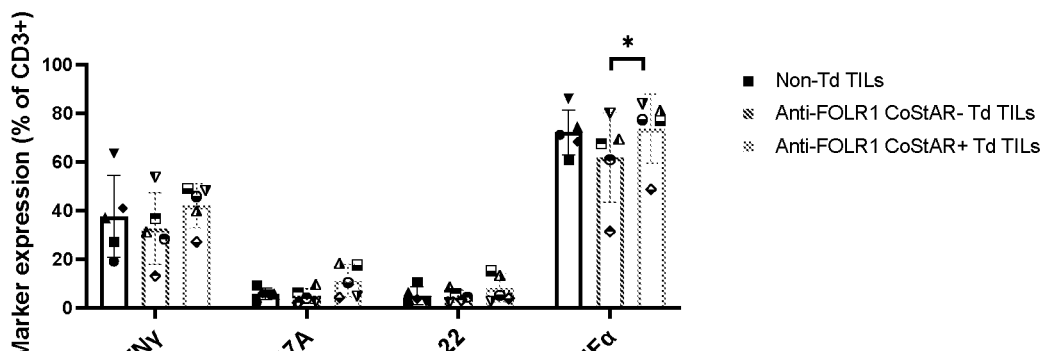
Figure 44B:
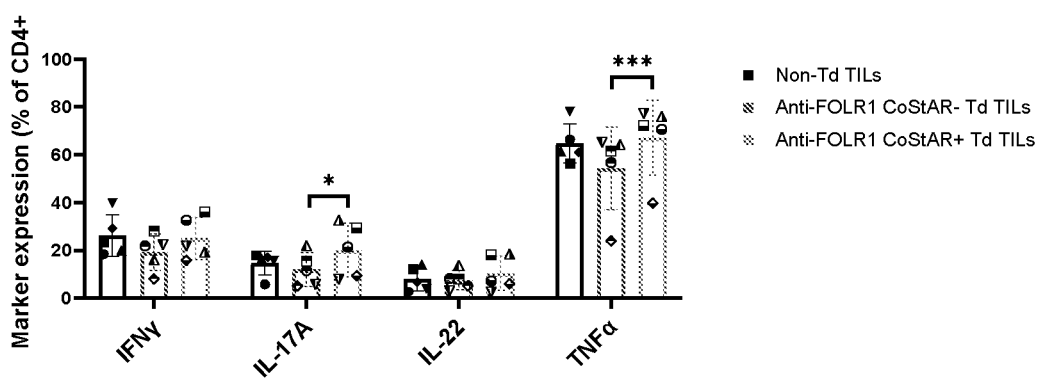
Figure 44C:
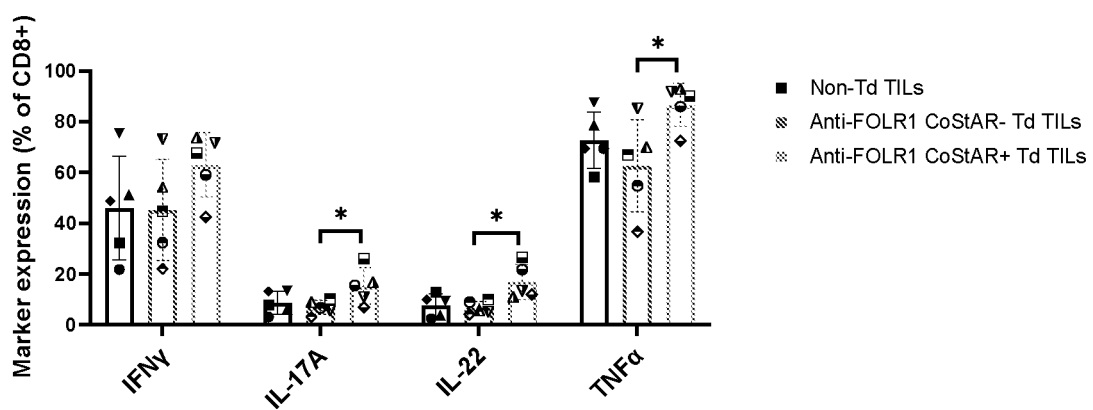

FIG. 44A-44C depicts effects of CoStAR modification of TIL on cytokine production upon mitogenic activation. Nontransduced (Non-Td), anti-FOLR1 CoStAR-transduced (Td) TILs and anti-FOLR1 CoStAR+Td TILs were assessed for the production of cytokines upon 4 hour stimulation with PMA (50 ng/mL)/Ionomycin (1 μg/mL) in CD3+(44A), CD4+(44B) and CD8+(44C) cell populations. Shapes corresponding to the each of the 5 OC samples are depicted regardless of the filling. Black, dark grey and light grey bars represent Non-Td TILs, anti-FOLR1 CoStAR− Td TILs and anti-FOLR1 CoStAR+Td TILs, respectively. Statistical analysis was performed using a two-way ANOVA with matched Tukey's multiple comparisons post-test. * p≤0.05, ***p≤0.001.

Figure 45:
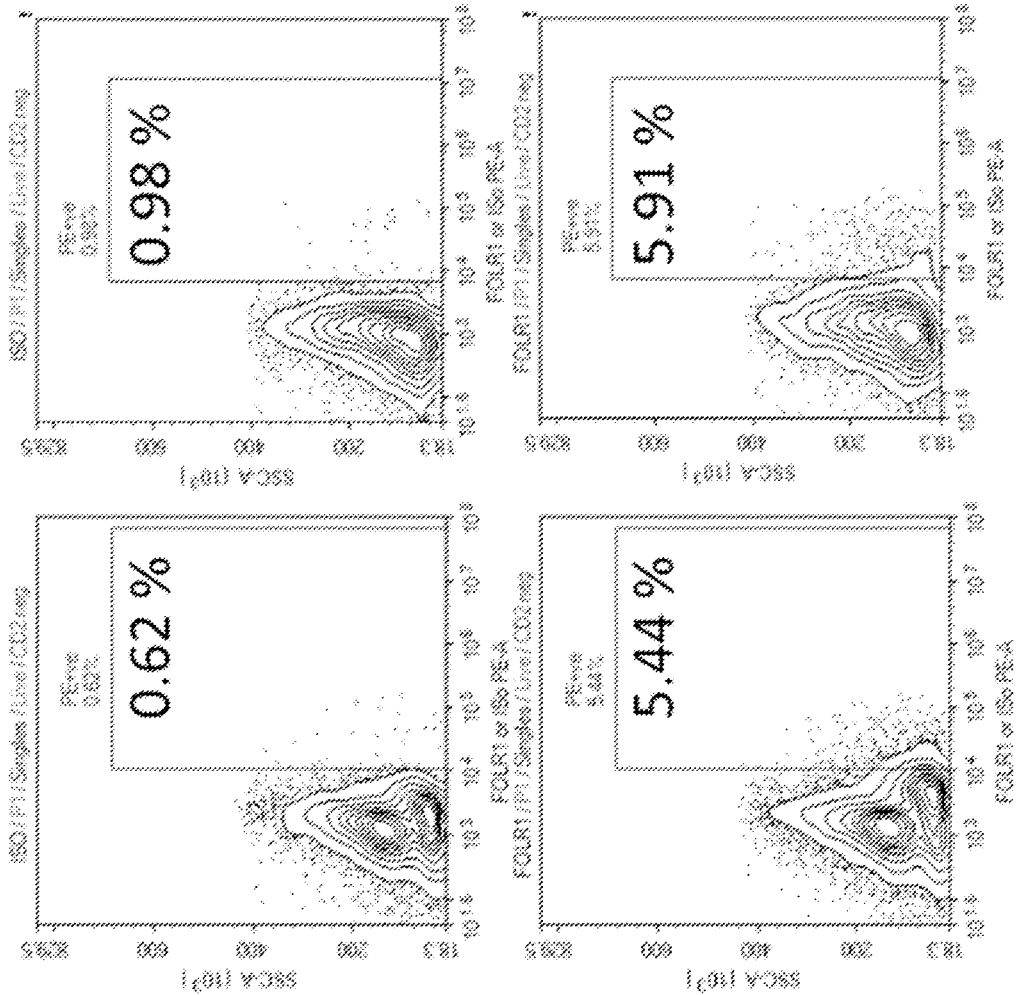

FIG. 45 depicts Expression of FOLR1 on OC digest cells. Cryopreserved autologous tumor digest was thawed and analyzed by flow cytometry to determine the surface expression of FOLR1 of each donor. All 5 donors used in the study are shown. Abbreviations: OC, ovarian cancer, FOLR1, folate receptor alpha; FOLR1 PE, anti-FOLR1 antibody conjugated to PE; PE, phycoerythrin.

FIG. 46A-46D depicts effect of CoStAR modification on cytokine producing cells upon coculture with autologous tumors. Non-Td and anti-FOLR1 CoStAR Td TILs were cocultured with autologous tumor digests for 16 hours and intracellular flow cytometry was performed to evaluate the proportion of cells producing cytokines. The frequency of IL-2 positive (46A) CD4 and (46B) CD8 TILs as well as the frequency of TNFα positive (46C) CD4 and (46D) CD8 TILs were assessed. Results represent 5 biological replicates with 3 technical replicates each. Statistical analysis was performed using a two-way ANOVA with Tukey's multiple comparisons test. *P<0.05.

FIG. 47A-47E depicts the effect of CoStAR modification on cytokine secretion upon coculture with autologous tumor digests expressing FOLR1. Non-Td and anti-FOLR1 CoStAR transduced (Td) TILs were cocultured with autologous tumor digest for 24 hours, following which supernatants were collected and analyzed for cytokine secretion using an MSD immunoassay. The graphs represent measured concentrations of (47A) IL-2, (47B) TNFα, (47C) IL-13 and (47D) IFNγ in coculture supernatants. (47E) Correlation between IFNγ concentration and FOLR1 expression by autologous digest as determined in FIG. 1. Results represent 5 biological replicates with 3 technical replicates each. Statistical analysis was performed using a two-way ANOVA with Sidak's multiple comparisons test. Correlation analysis was performed using a simple linear regression. *P<0.05, P<0.01, *P<0.001.

Figure 48:
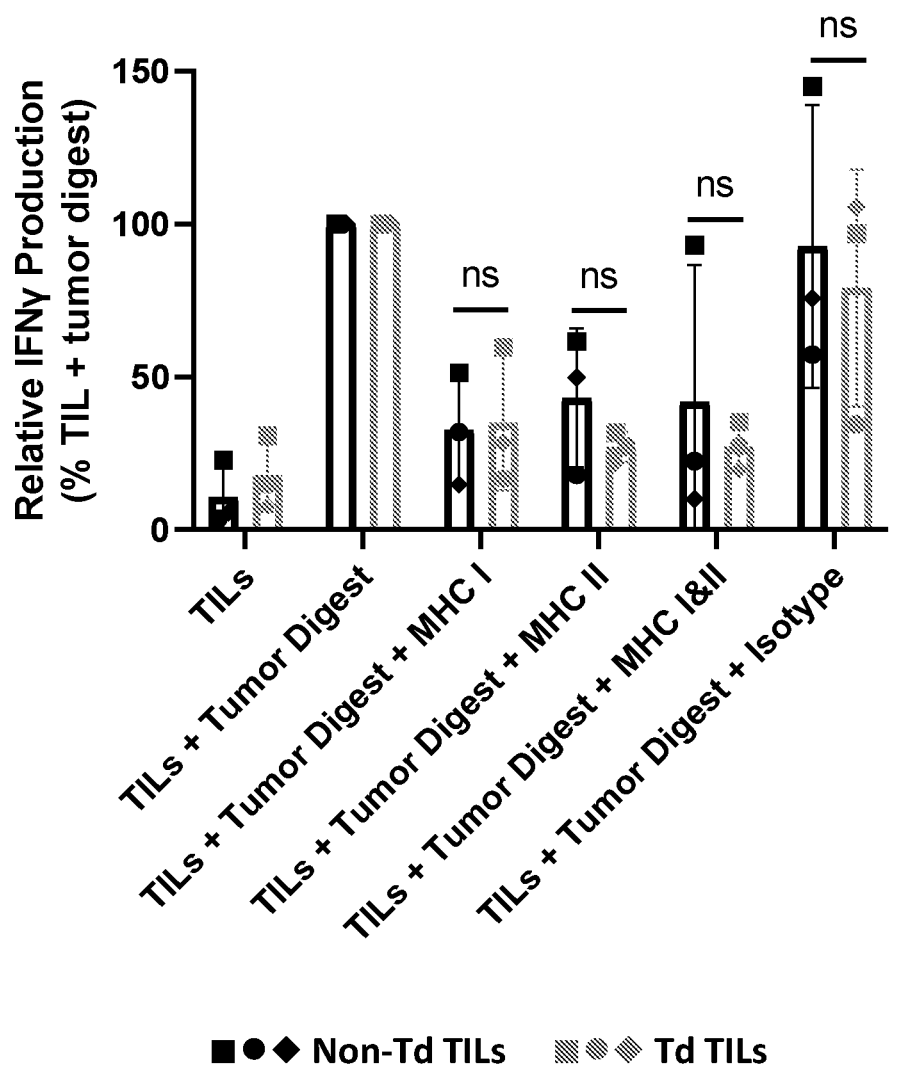

FIG. 48 depicts assessment of MHC-dependent CoStAR functionality in cocultures with autologous tumor digests. Non-Td and anti-FOLR1 CoStAR transduced (Td) TILs were cocultured with autologous tumor digests in the presence of MHC blocking reagents or isotype controls for 24 hours. The supernatants were then analyzed for IFNγ cytokine production using the MSD immunoassay. Results represent 3 biological replicates with 3 technical replicates each. Statistical analysis was performed using a two-way ANOVA with Tukey's multiple comparisons test.

Figure 49B:
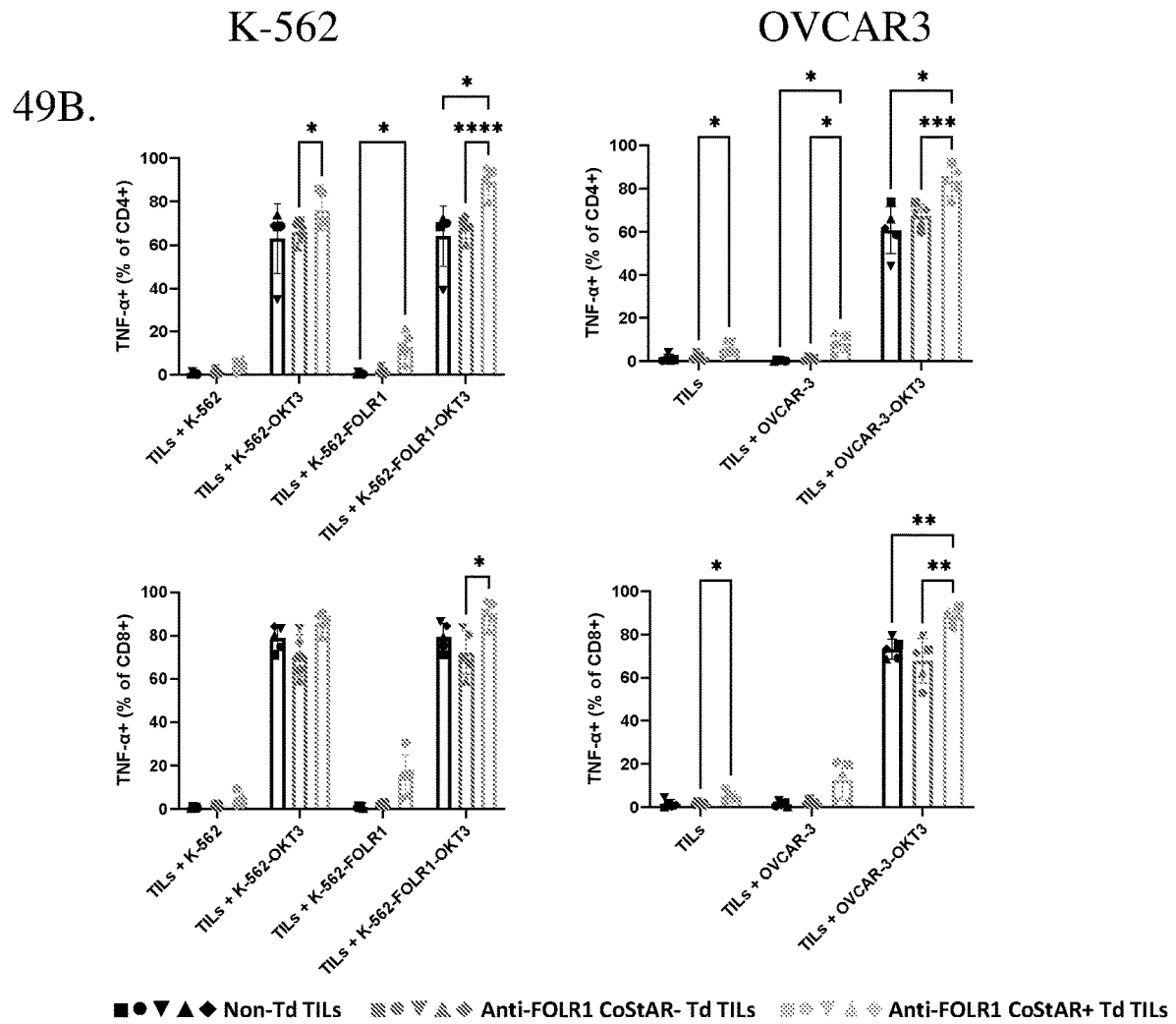

FIG. 49A-49B depicts the effect of CoStAR modification in cytokine producing cell frequencies upon coculture with engineered cell lines. Non-Td and anti-FORL1 CoStAR transduced (Td) TILs were cocultured with engineered target cell lines for 16 hours and cytokine producing cells were measured using intracellular flow cytometry. Frequency of IL-2 positive (49A) in CD4+(top) and CD8+(bottom) TILs following coculture with K-562 (left) and OVCAR-3 (right)

derived lines. Frequency of TNFα positive (49B) in CD4+ (top) and CD8+(bottom) TILs following coculture with K-562 (left) and OVCAR-3 (right) derived lines. Results represent 5 biological replicates with 3 technical replicates each. Statistical analysis was performed using a two-way ANOVA with Tukey's multiple comparisons test. *P<0.05, P<0.01, *P<0.001, ****P<0.0001.

FIG. 50A-50D depicts the effect of CoStAR modification in cytokine secretion upon coculture with engineered cell lines. Non-Td and anti-FOLR1 CoStAR transduced (Td) TILs were cocultured with engineered target cell lines for 24 hours and MSD immunoassay was performed to evaluate the concentration of cytokines secreted. Cytokine concentrations for (50A) IL-2, (50B) TNFα, (50C) IL-13 and (50D) IFNγ following cocultures with (left) K-562, and (right) BA/F3 derived cell lines are shown. The results represent 5 biological replicates with 3 technical replicates each. Statistical analysis was performed using a two-way ANOVA with Tukey's multiple comparisons test. *P<0.05, P<0.01, *P<0.001, ****P<0.0001.

Figure 51A:
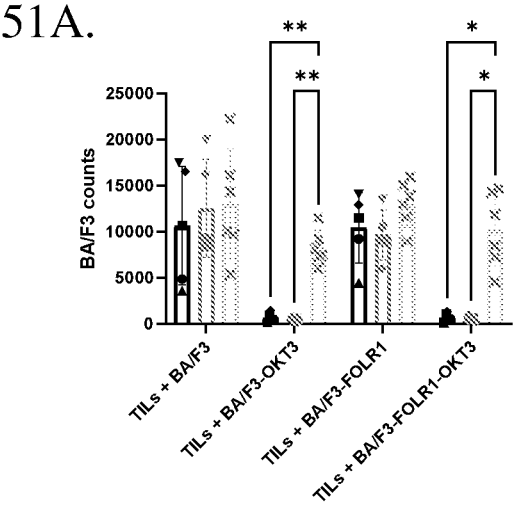
Figure 51B:
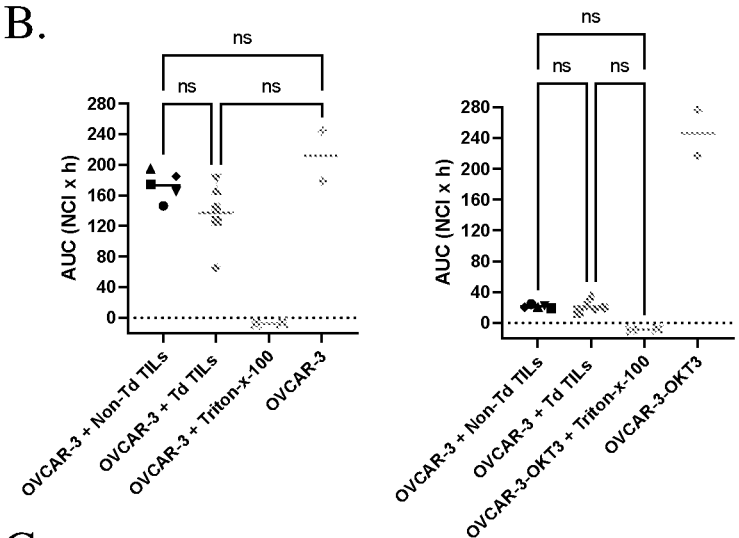
Figure 51C:
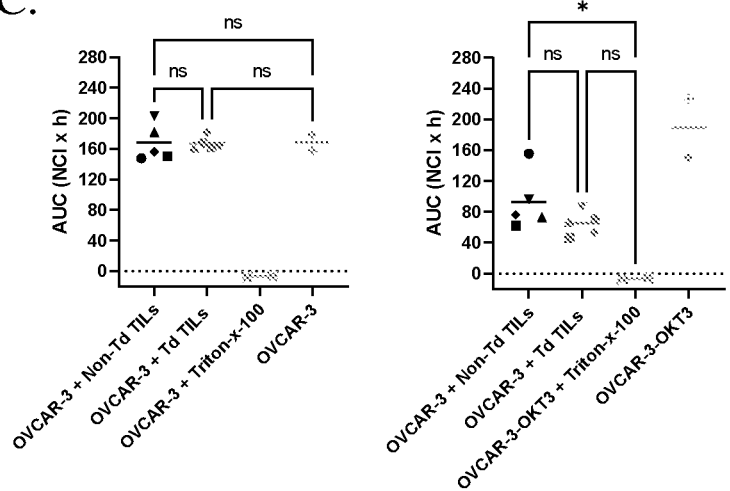
Figures 52A, 52B, 52C, 52D:
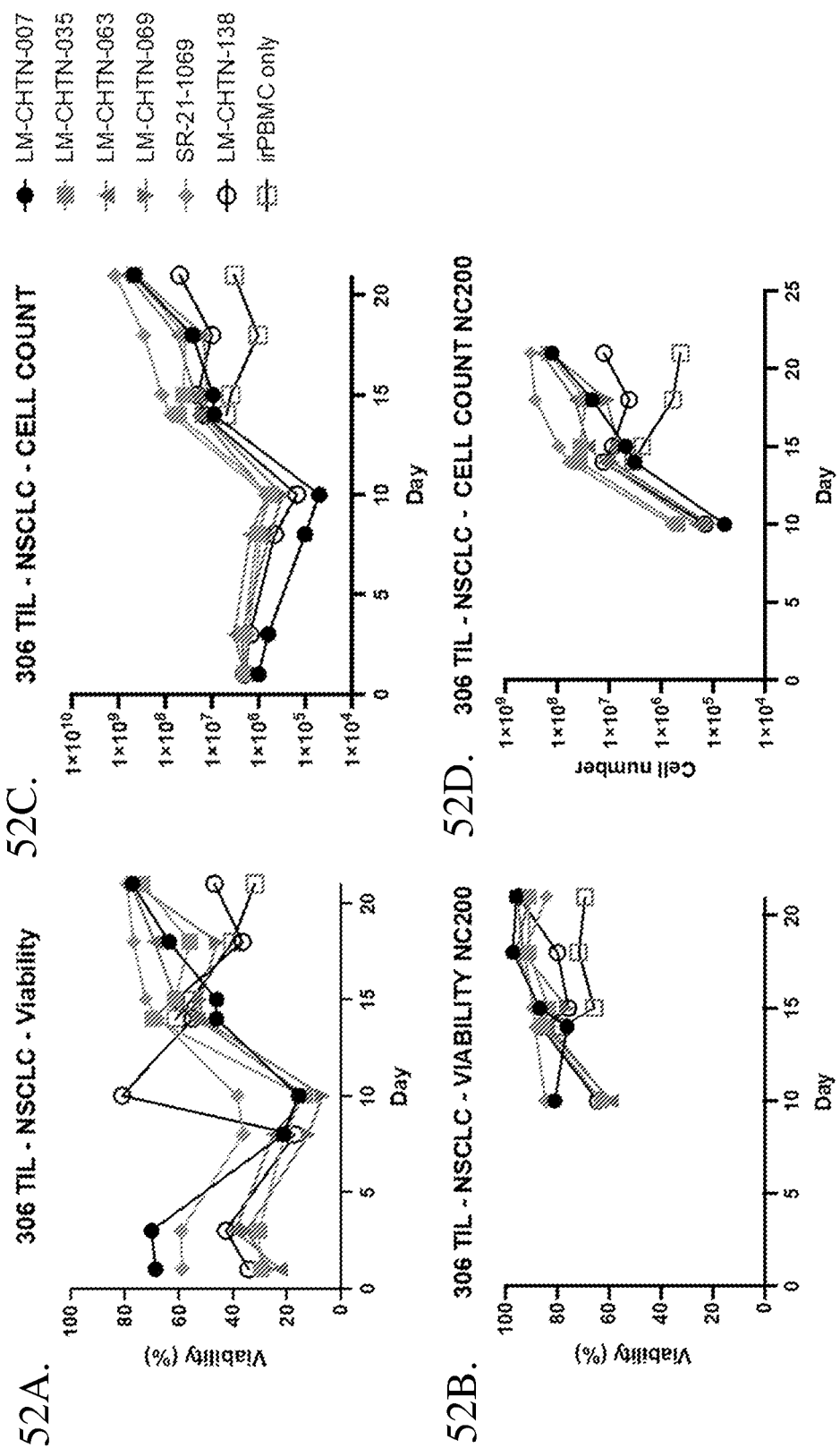

FIG. 51A-51C depicts assessment of the impact of CoStAR modification on the cytotoxic capacity of TILs against OKT3 bearing targets. Non-Td and anti-FOLR1 CoStAR transduced (Td) TILs were cocultured with BA/F3 or OVCAR-3 engineered cell lines and the cytotoxicity was assessed using a flow cytometry based (51A) and an xCELLigence-based assay (51B and 51C), respectively. (51B) E:T ratio of 1:5 and (51C) E:T ratio of 1:30. Results represent 5 biological replicates with 3 technical replicates each. Statistical analysis was performed using a two-way ANOVA with Tukey's multiple comparisons test for flow cytometry data and 1-way ANOVA with Tukey's multiple comparisons test for xCELLigence data. *P<0.05, **P<0.01.

FIG. 52A-52D depicts expansion of NSCLC TILs with >80% viability and ~100-200 million cells, 40-55% CoStar transduction in CD3+ T cells and >90% CD3+ T cell purity.

Figure 53:
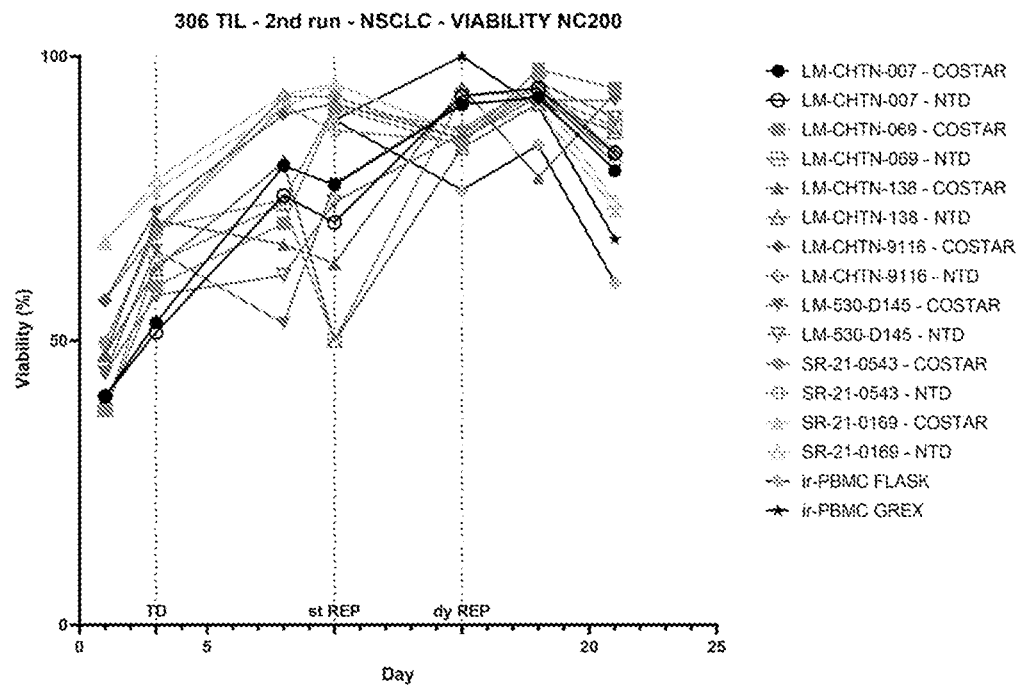

FIG. 53 depicts expansion of NSCLC TILs with >80% viability. There was no difference in CoStAR transduced and nontransduced populations in terms of viability and cell expansion.

Figure 54:
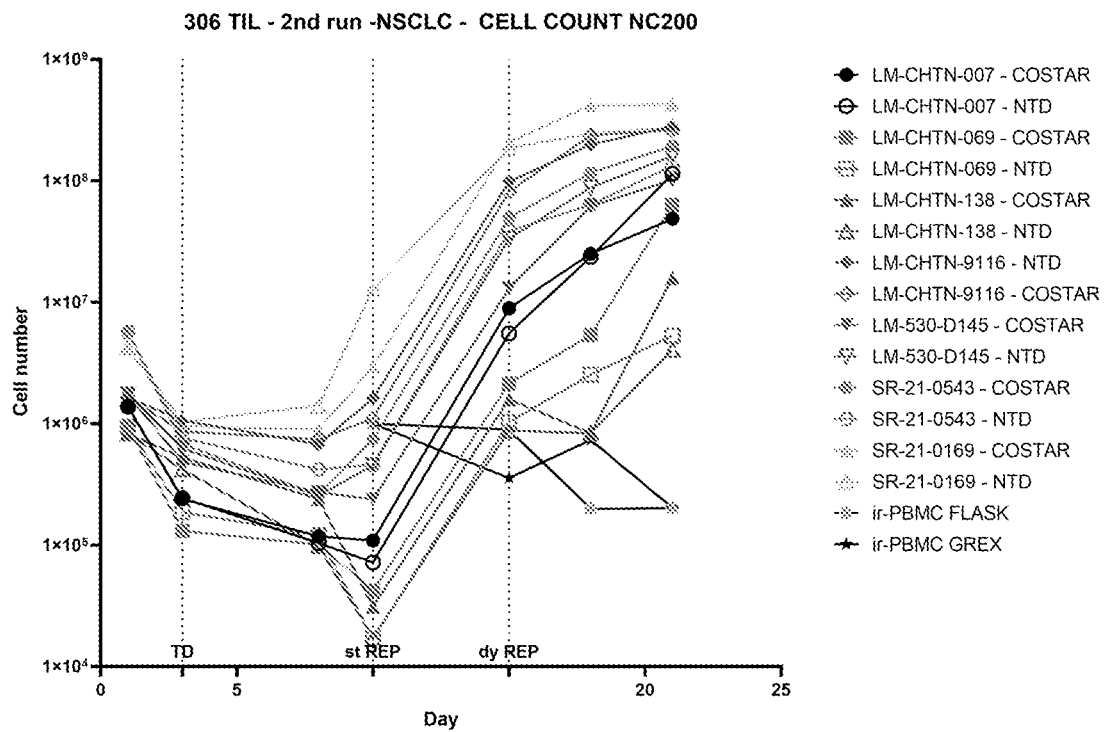

FIG. 54 depicts expansion of NSCLC TILs with 50-500 million cells at harvest. There was no difference in CoStAR transduced and nontransduced populations in terms of viability and cell expansion.

Figure 55:
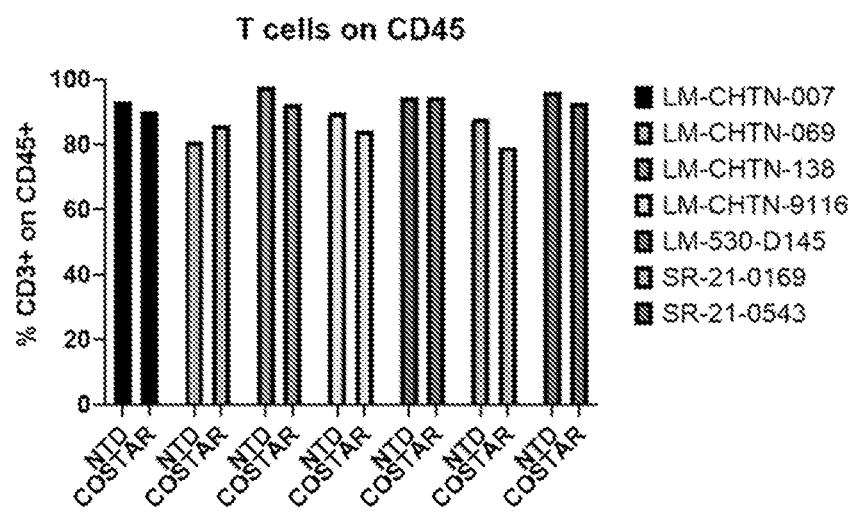

FIG. 55 depicts T cell populations of seven patient samples.

Figure 56:
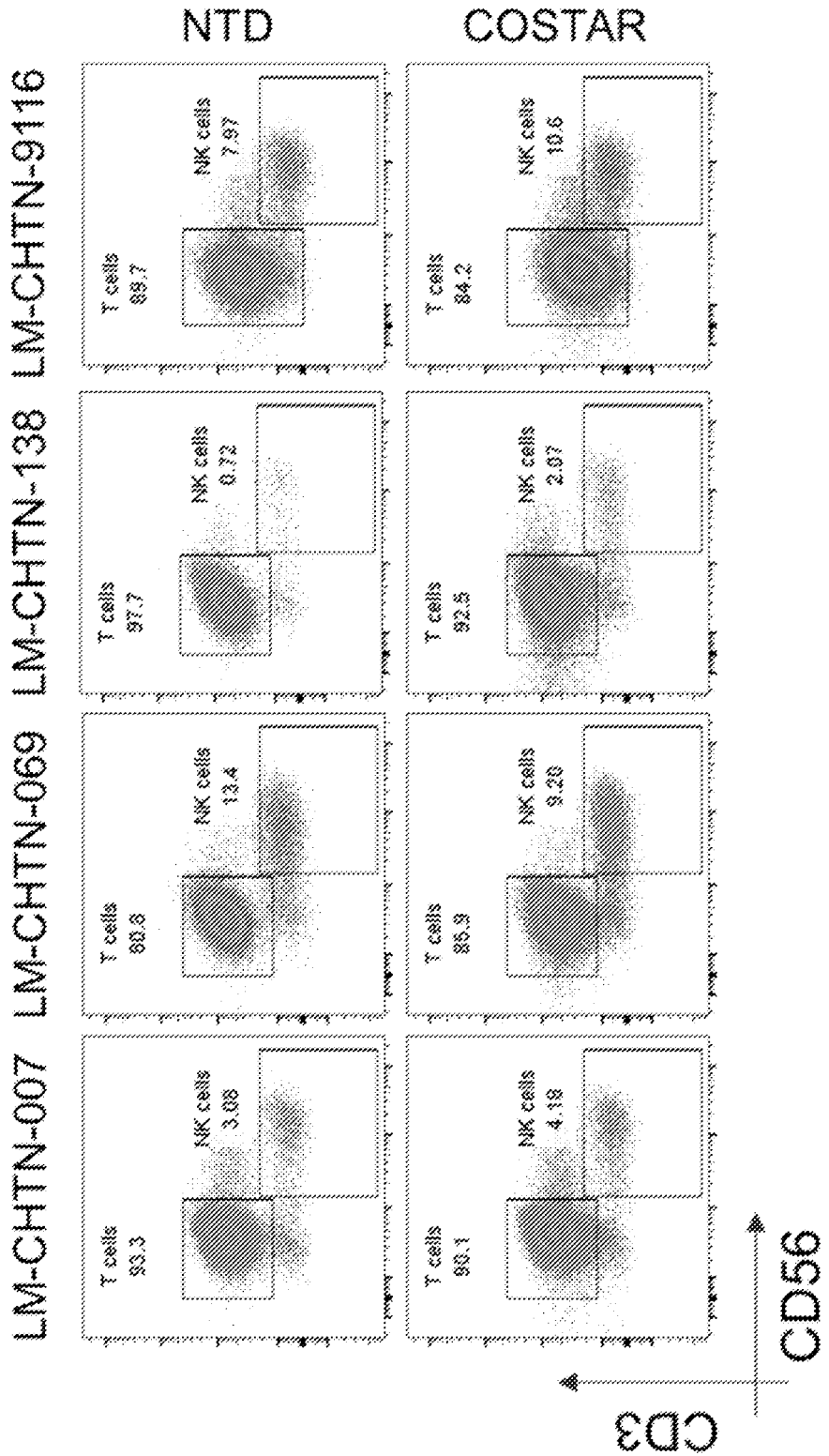
Figure 56:
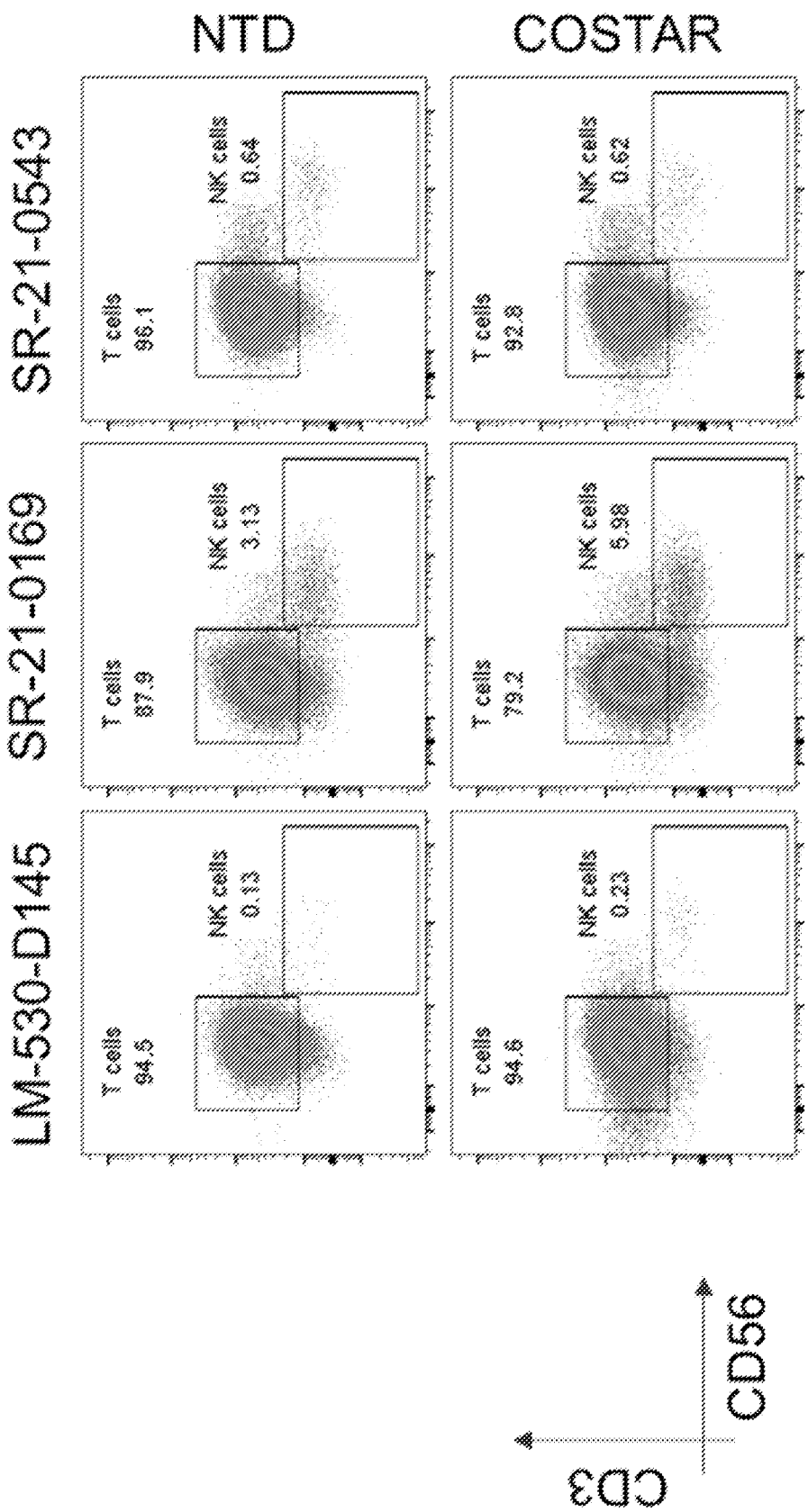

FIG. 56 depicts CD3 vs CD56 which marks CD3+ as T cells and CD3-CD56+ as NK cells.

Figure 57:
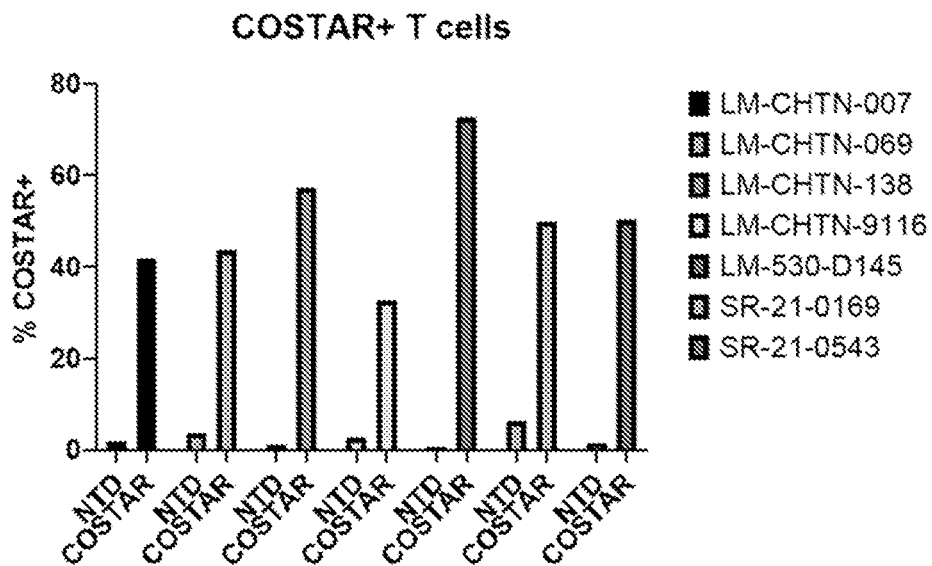

FIG. 57 depicts quantification of non-transduced and CoStAR transduced T cells.

Figure 58:
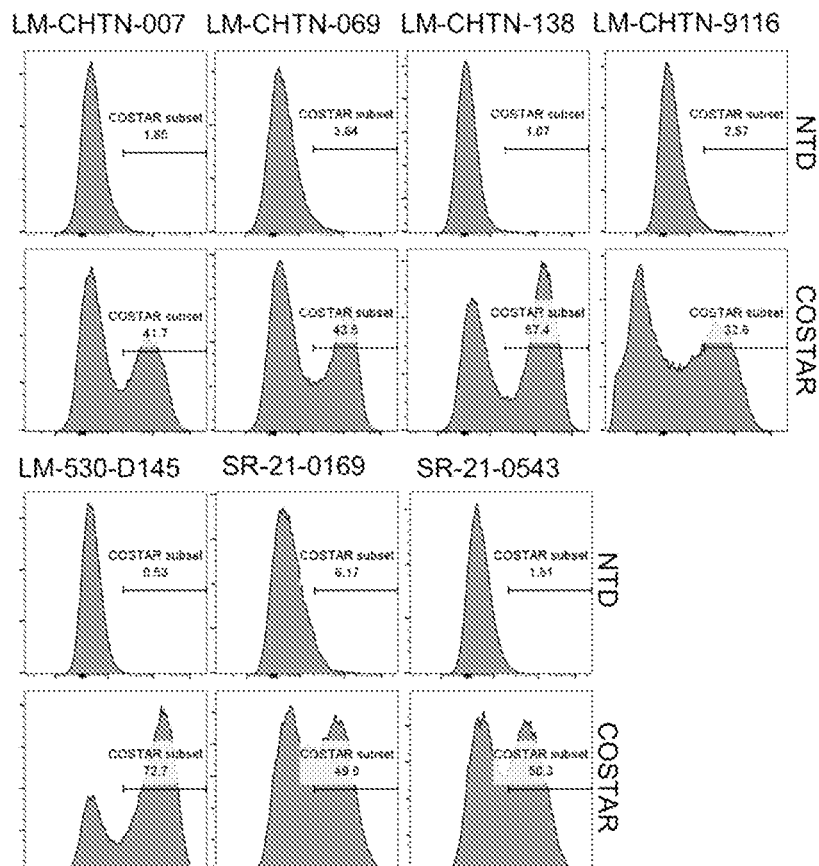
Figures 59A, 59B, 59C, 59D:
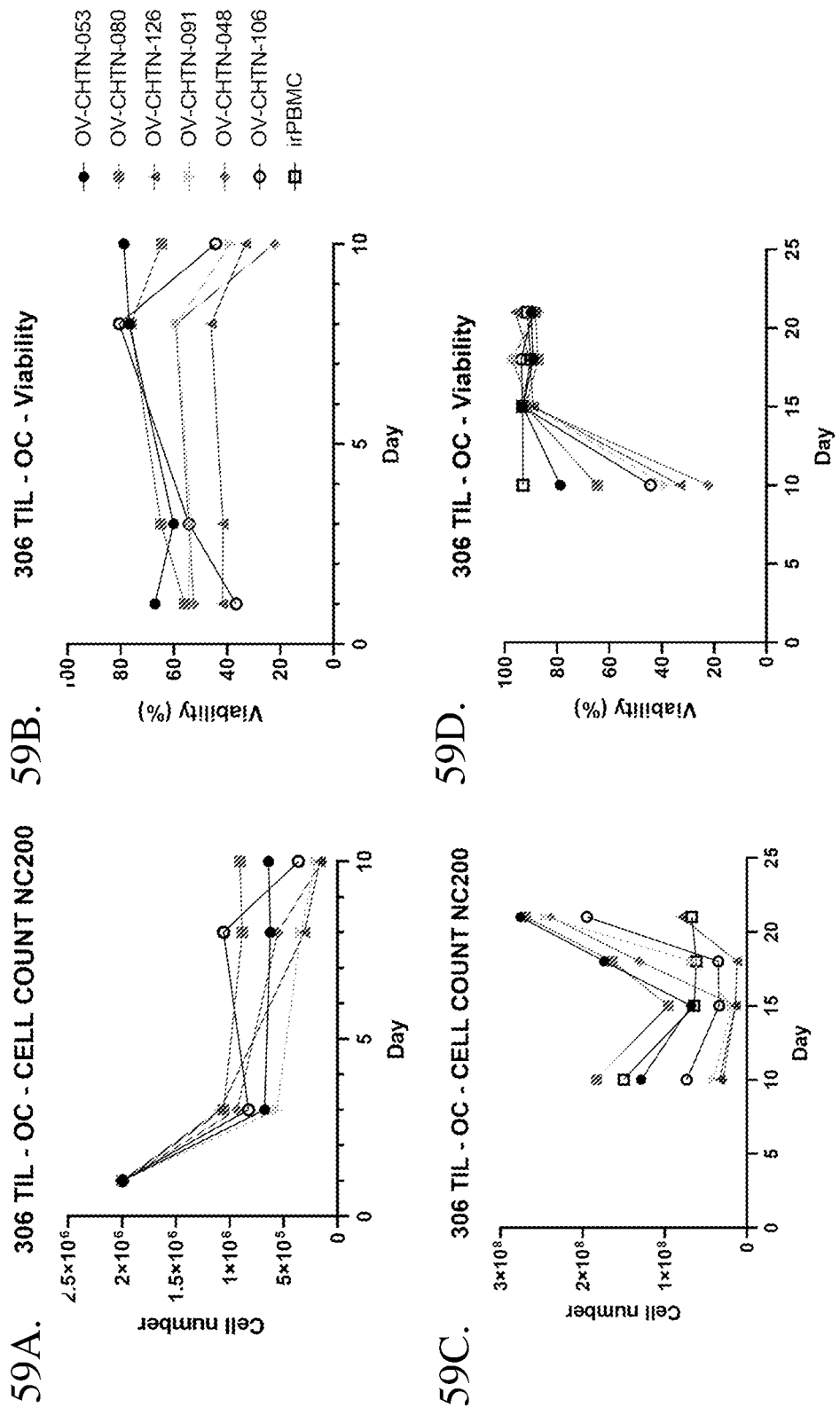
Figures 60A, 60B, 60C, 60D:
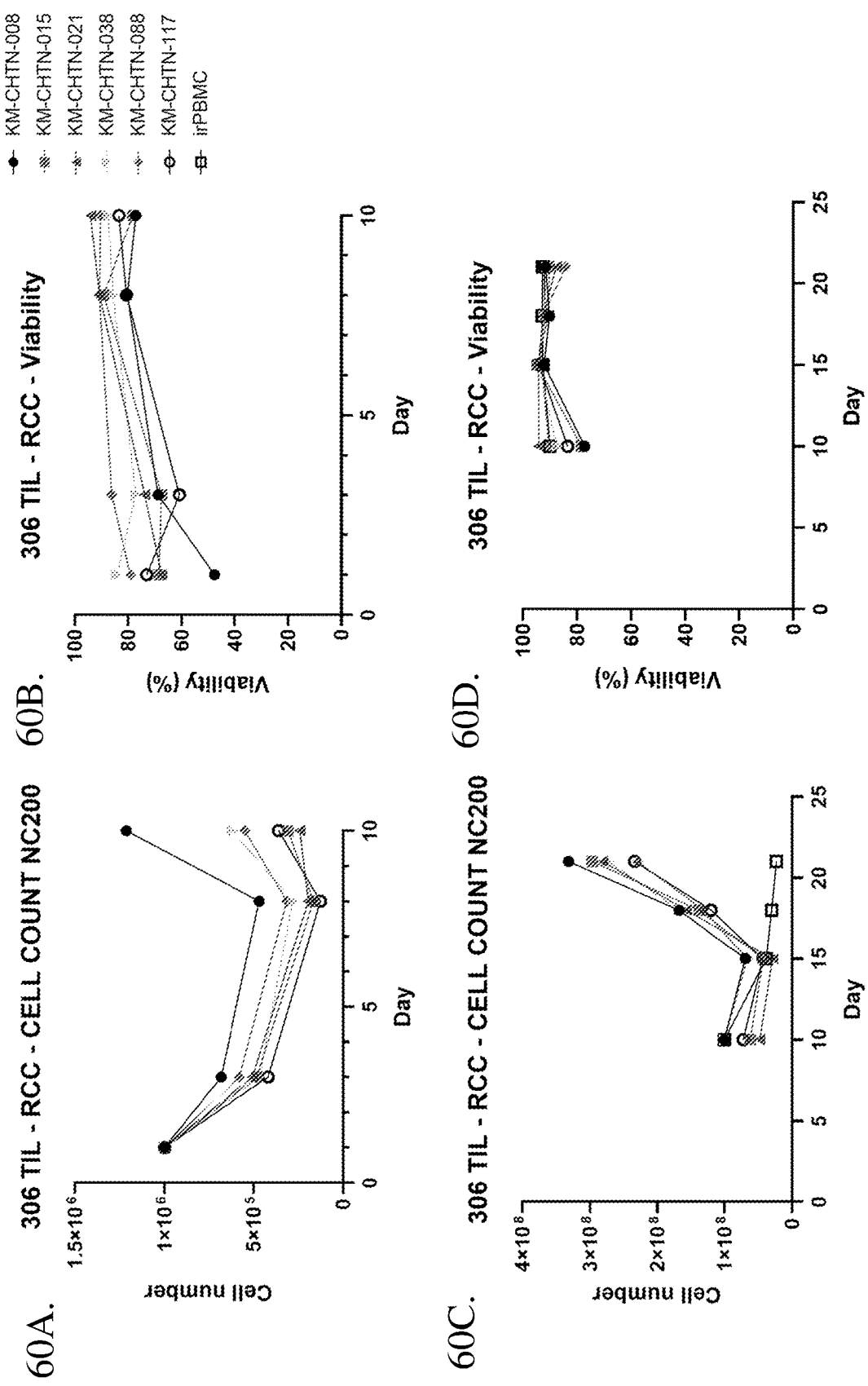

FIG. 58 depicts CoStAR staining on T cell subsets.

FIG. 59A-59D depicts significant increase in viability of ovarian cancer TILs during REP and >90% viability at the end of the manufacturing process, with 100-300 million cells at harvest.

FIG. 60A-60D depicts depicts renal cancer TILs demonstrated consistently >50% viability during outgrowth and >90% viability at the end of the manufacturing process, with 100-350 million cells at harvest.

FIG. 61A-61B depicts IHC performed with anti mesothelin antibody (clone 5B2) with a Dako Autostainer Link 48 according to standard protocols. Scoring was evaluated by a pathologists interpretation of % cells positive for 5B2 binding. H-scores were calculating the % cells positive for 5B2 binding multiplied by a pathologists estimation of: 0 (no staining) 1 (weak staining), 2 (moderate staining) or 3 (strong staining).

FIG. 62 depicts surface expression of scFV anti-MSNL CoStARs comprising of different scFV domains but retaining all other domains across constructs. Cells were assessed for transduction efficiency on day four post transduction, via surface detection of the marker gene truncated CD34 (tCD34) using an anti-CD34-APC (black bars) or the CoStAR molecule using a primary MSNL-PE antibody (grey bars). The results represent one biological replicate.

Figure 63A:
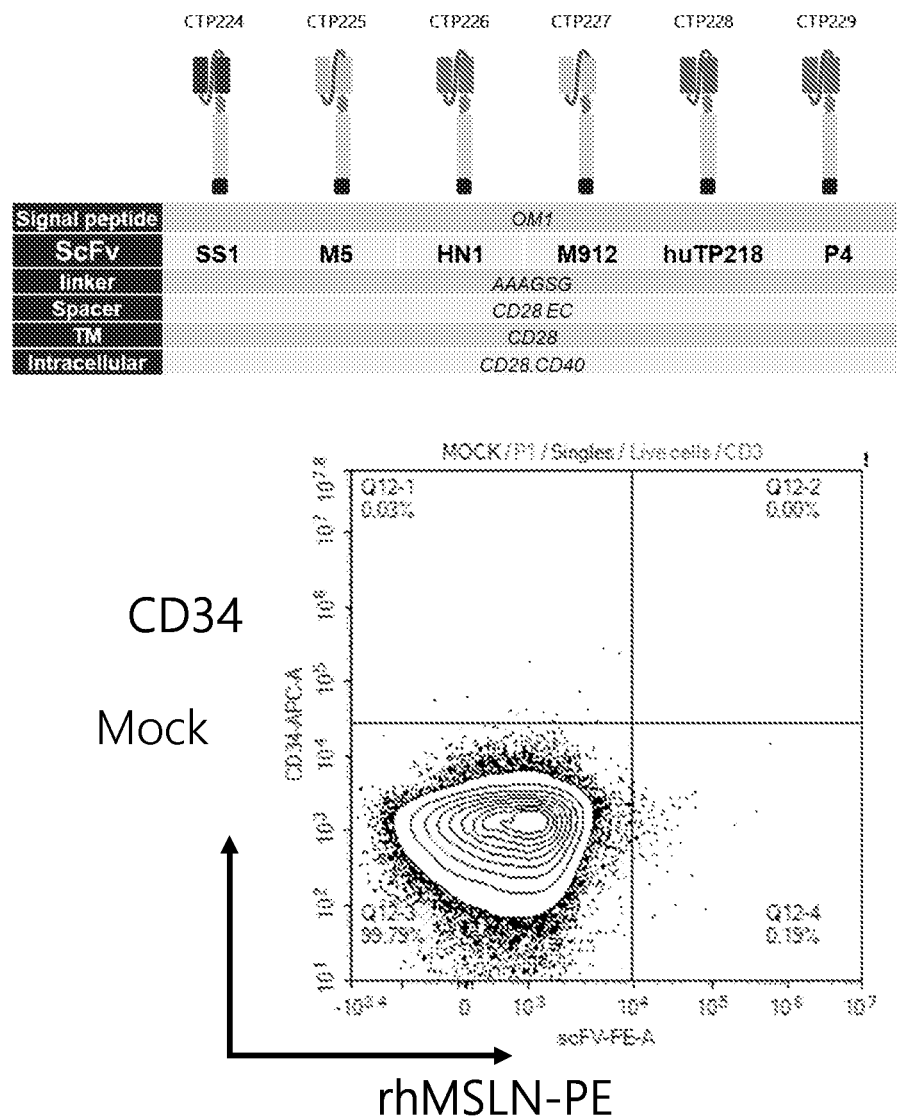
Figure 63B:
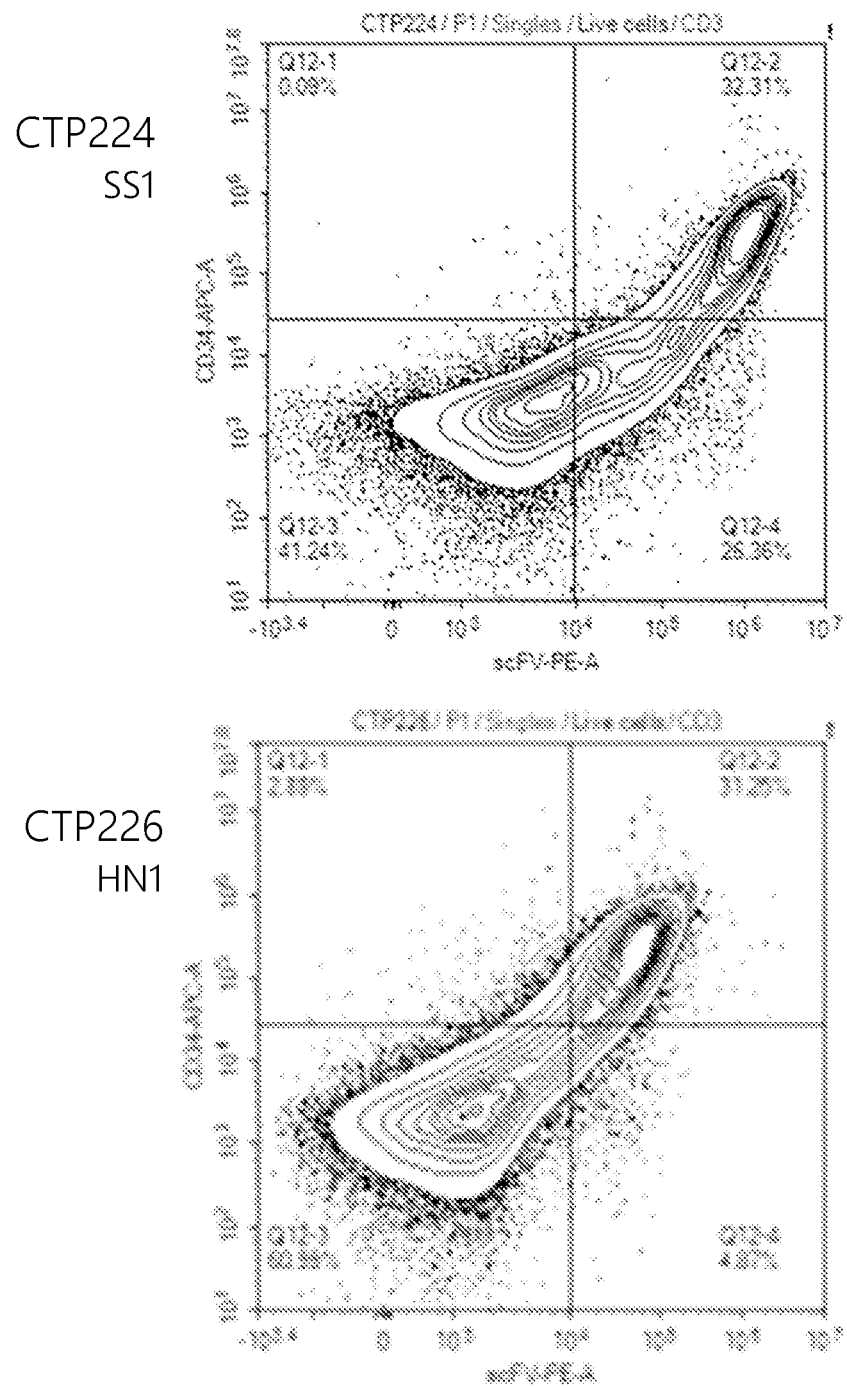
Figure 63B:
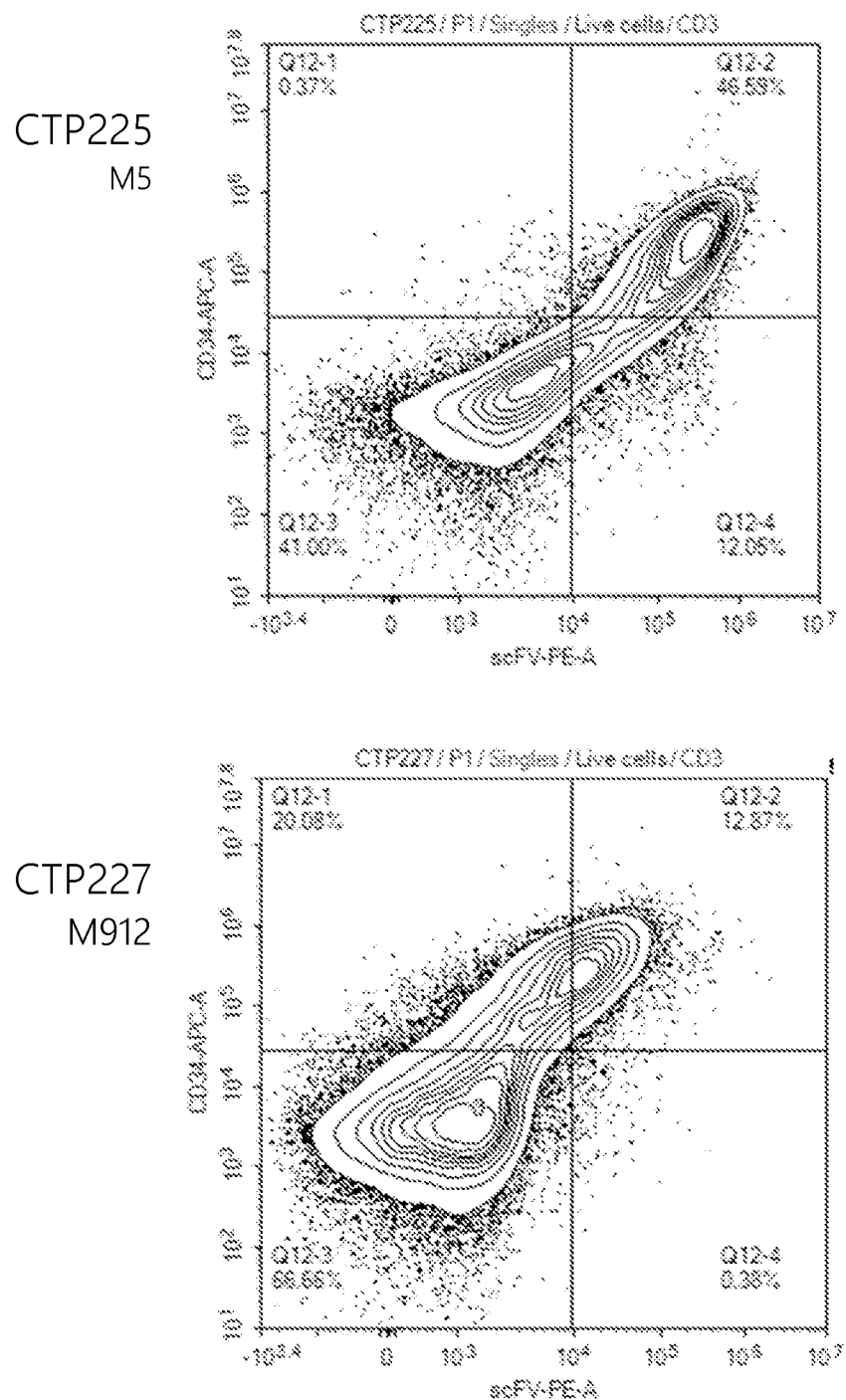
Figure 63B:
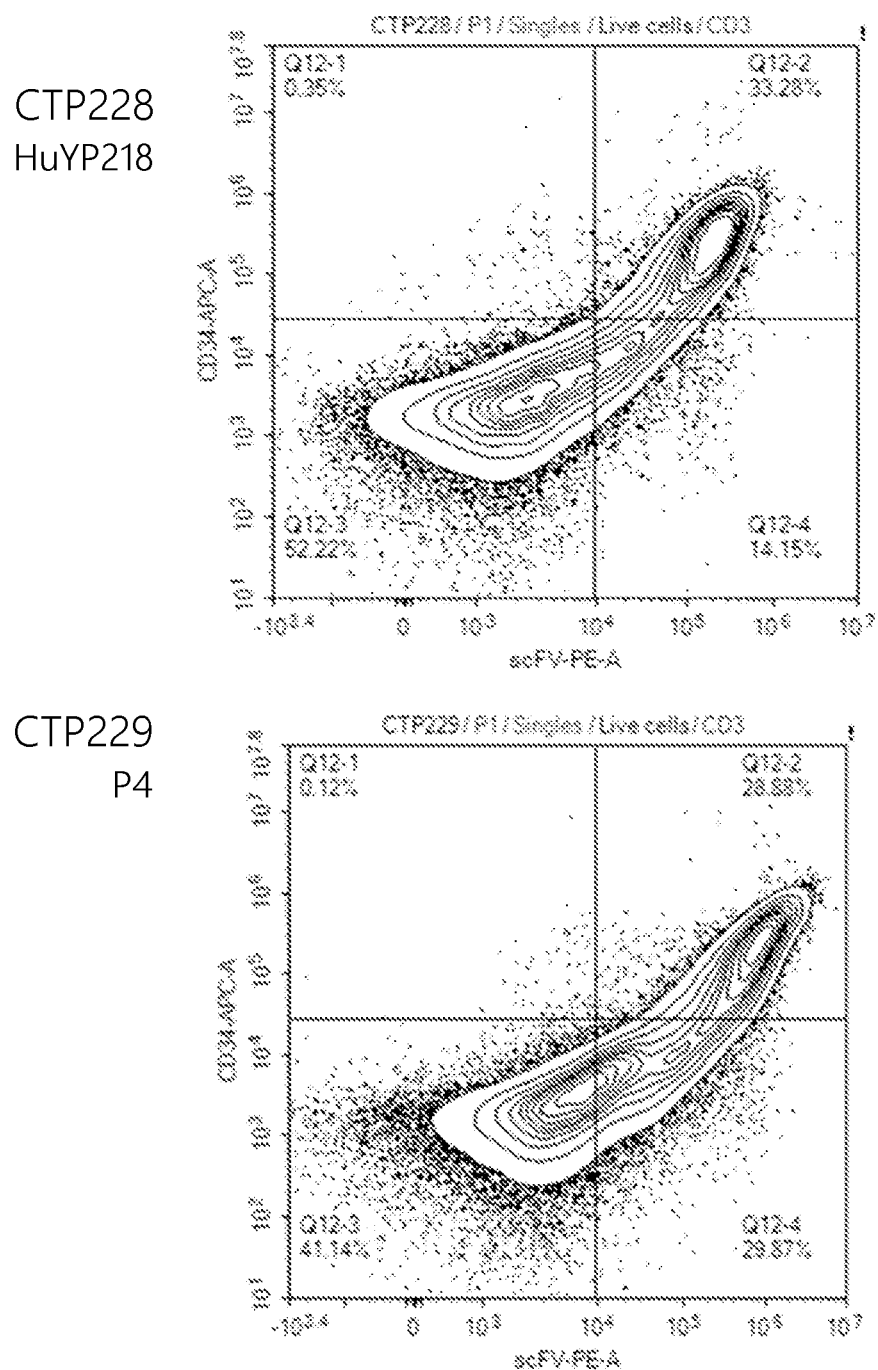

FIG. 63A-63B depicts dot plots of the surface expression of scFV anti-MSNL CoStARs comprising of different scFV domains but retaining all other domains across constructs. Cells were assessed for transduction efficiency on day four post transduction, via surface detection of the marker gene truncated CD34 (tCD34) using an anti-CD34-APC (y axis) or the CoStAR molecule using a primary MSNL-PE antibody (x axis).

Figure 64:
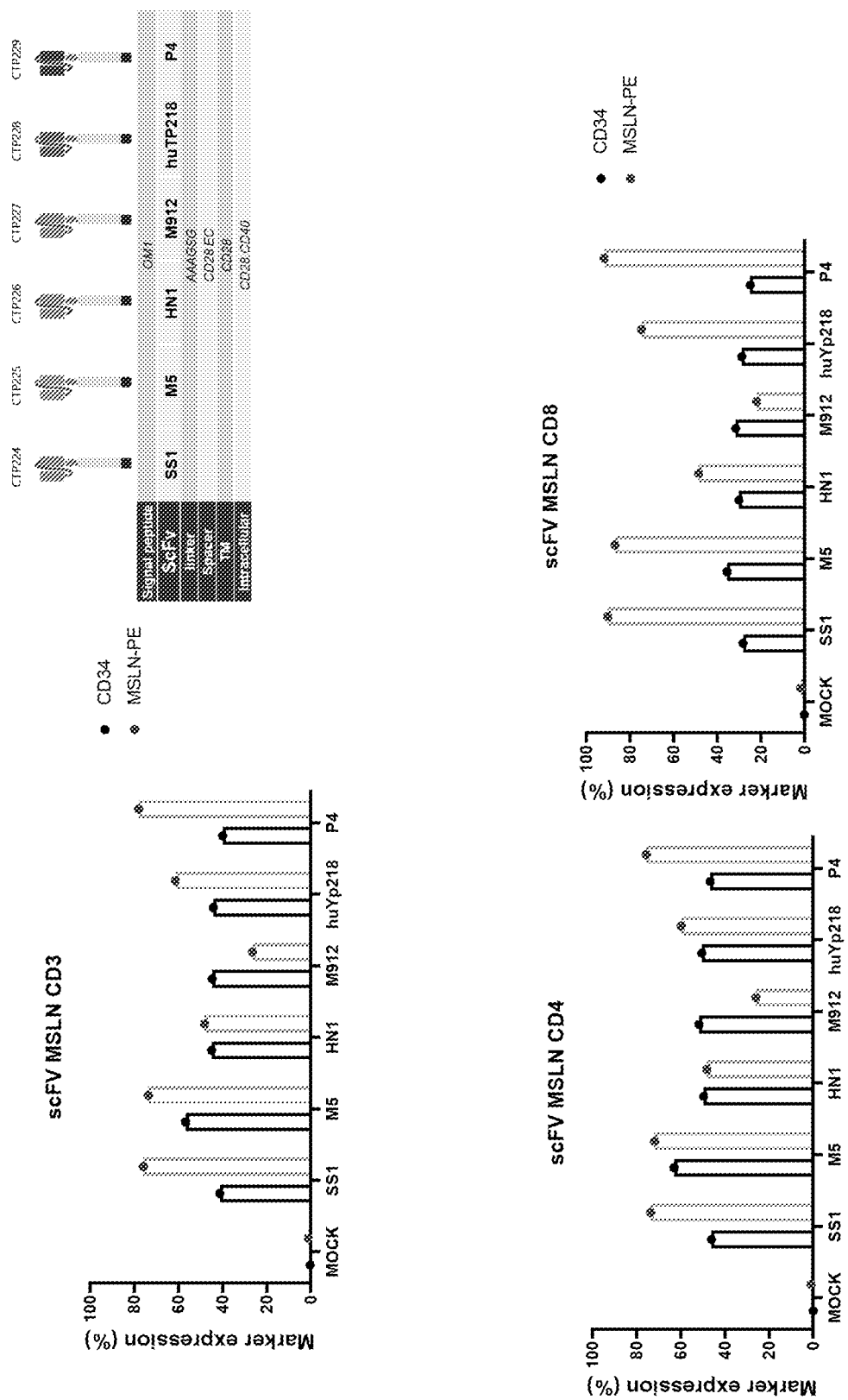

FIG. 64 depicts surface expression of scFV anti-MSNL CoStARs comprising of different scFV domains but retaining all other domains across constructs. Cells were assessed for transduction efficiency on day four post transduction via surface detection of the marker gene truncated CD34 (tCD34) using an anti-CD34-APC (black bars, black circles) or the CoStAR molecule using a primary MSNL-PE antibody (grey bars, red circles). Each graph represents the transduction efficiency on CD3, CD4 and CD8 populations. The results represent one biological replicate.

Figure 65:
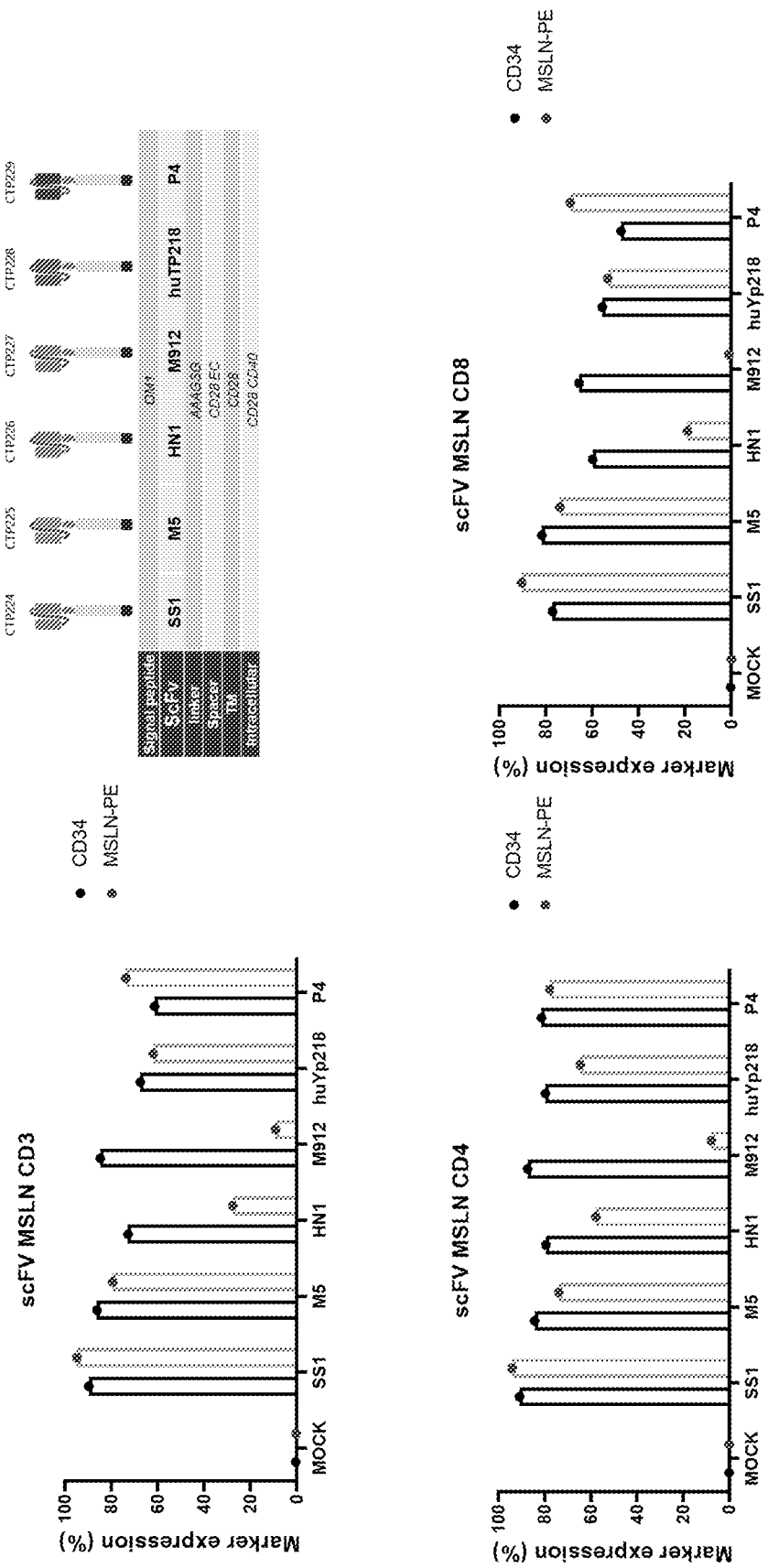

FIG. 65 depicts surface expression of scFV anti-MSNL CoStARs comprising of different scFV domains but retaining all other domains across constructs. Cells were sorted using CD34 microbeads and placed into a rapid expansion protocol (REP) for 14 days. Following expansion, anti-CD34-APC (black bars, black circles) or the CoStAR molecule using a primary MSNL-PE antibody (grey bars, red circles). Each graph represents the transduction efficiency on CD3, CD4 and CD8 populations. The results represent one biological replicate.

Figure 66:
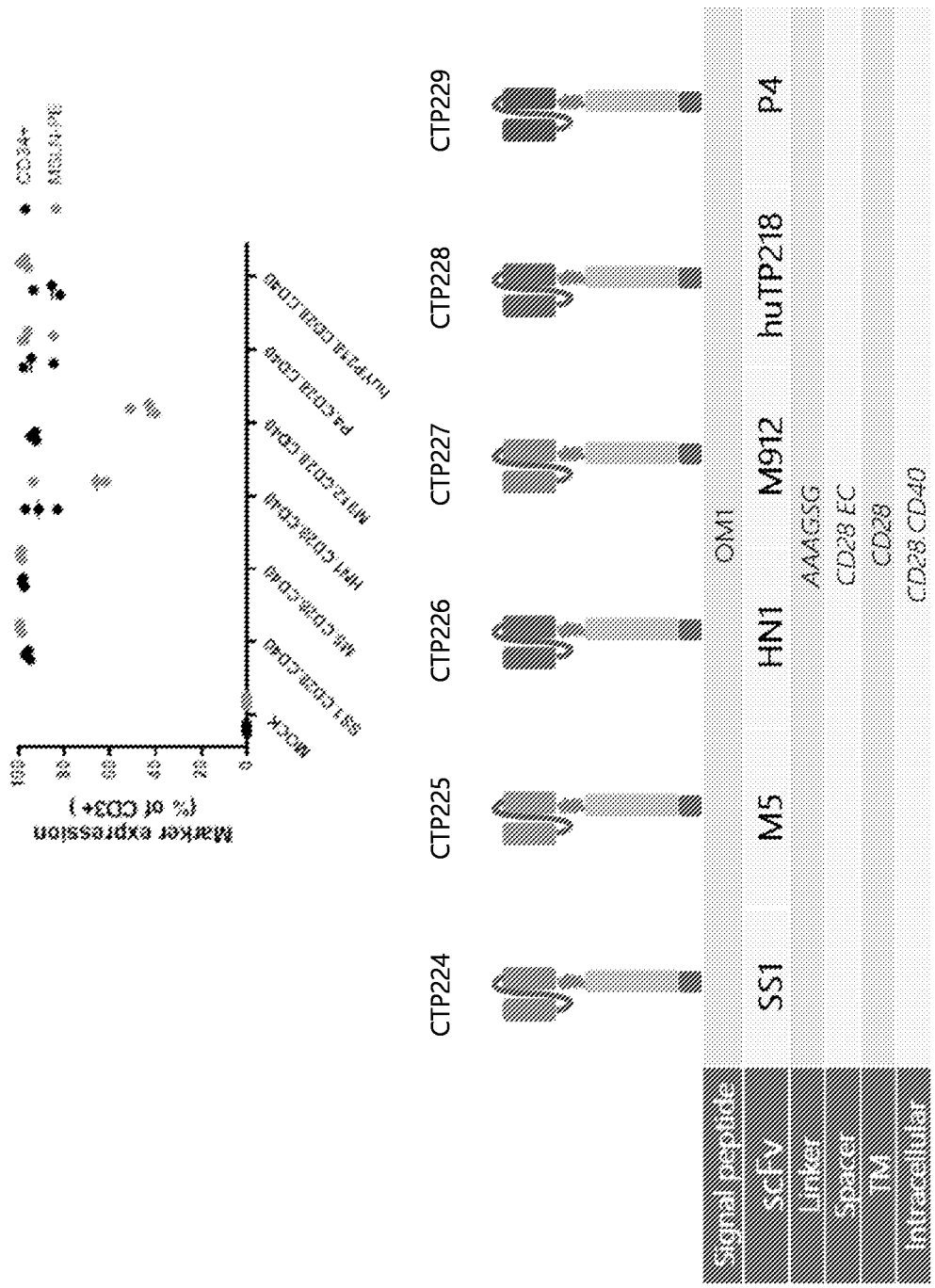

FIG. 66 depicts surface expression of scFV anti-MSNL CoStARs comprising of different scFV domains but retaining all other domains across constructs. Cells were sorted using CD34 microbeads and placed into a rapid expansion protocol (REP) for 14 days. Following expansion, anti-CD34-APC (black circles) or the CoStAR molecule using a primary MSNL-PE antibody (red circles). Each graph represents the transduction efficiency on CD3 cell population. The results represent 3 biological replicates.

Figure 67:
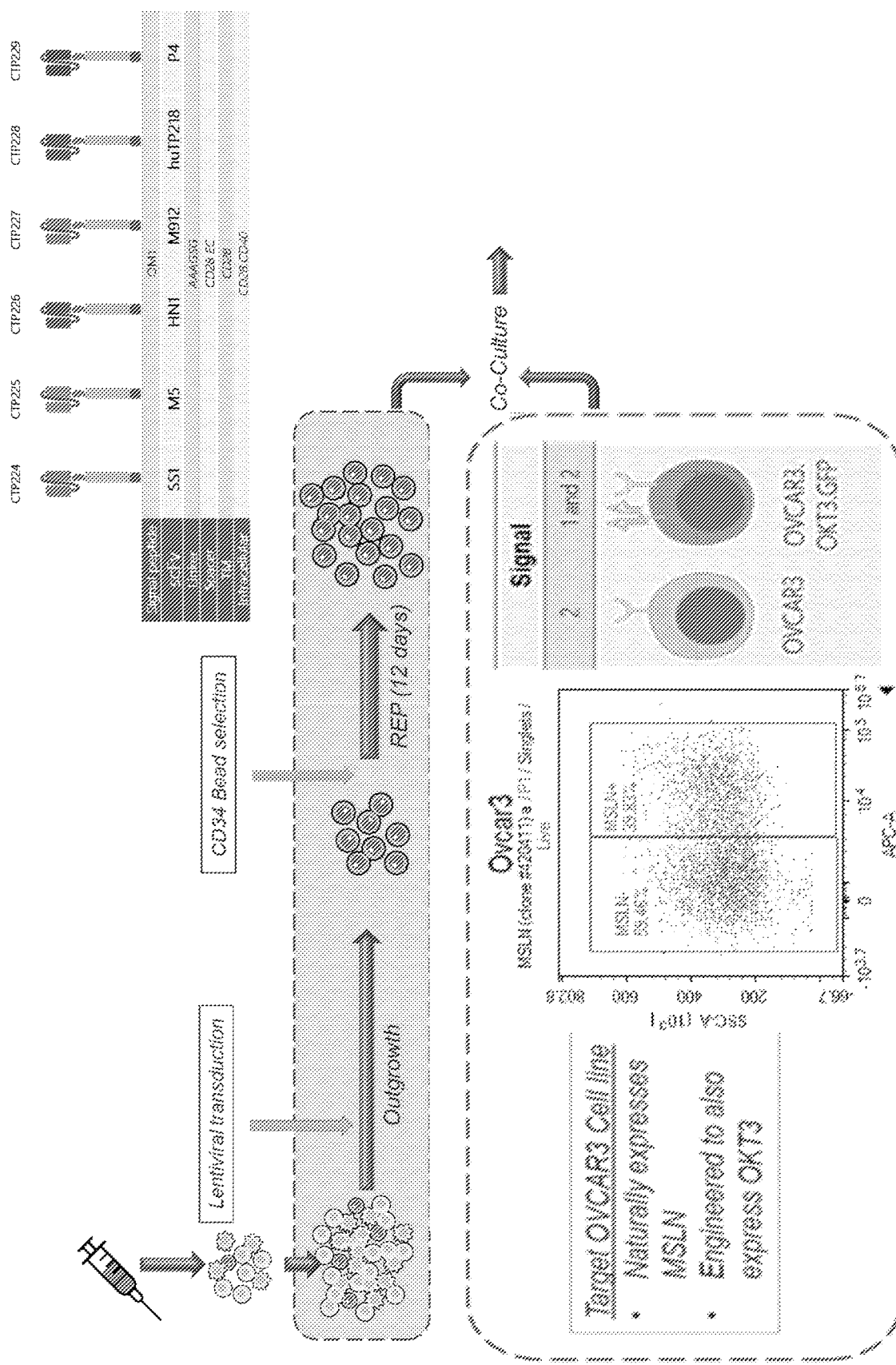
Figure 67:
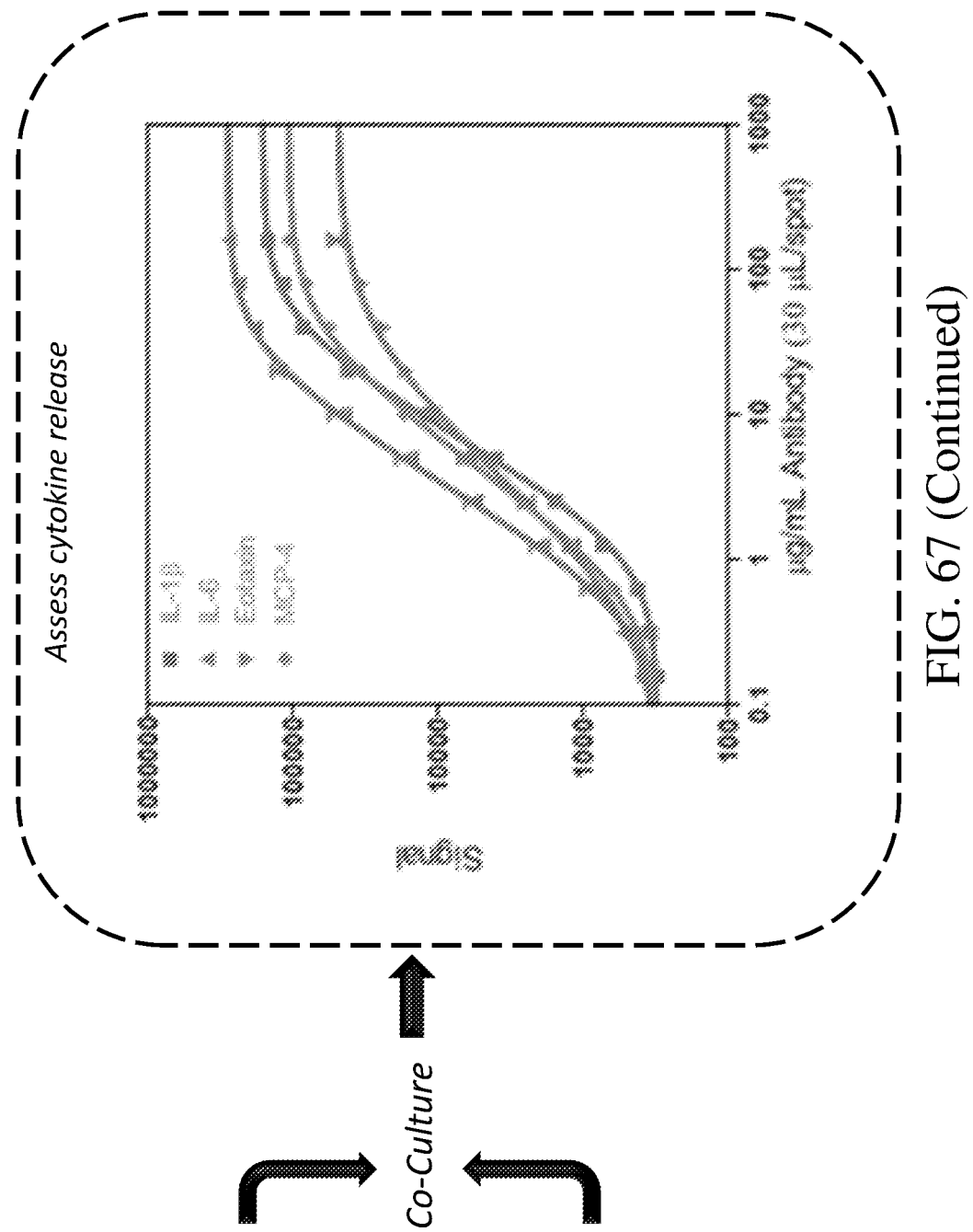
Figure 68:
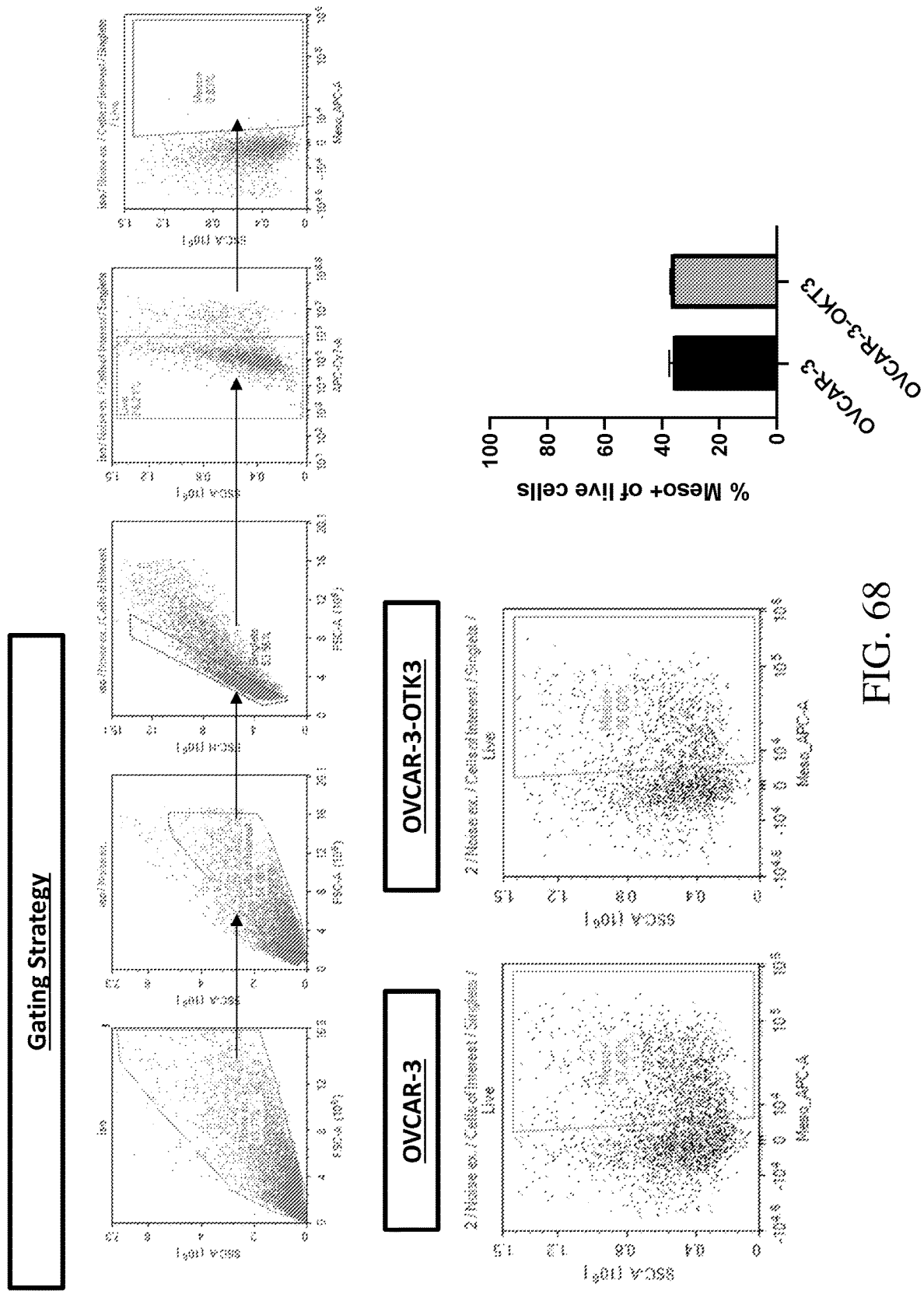
Figure 69A:
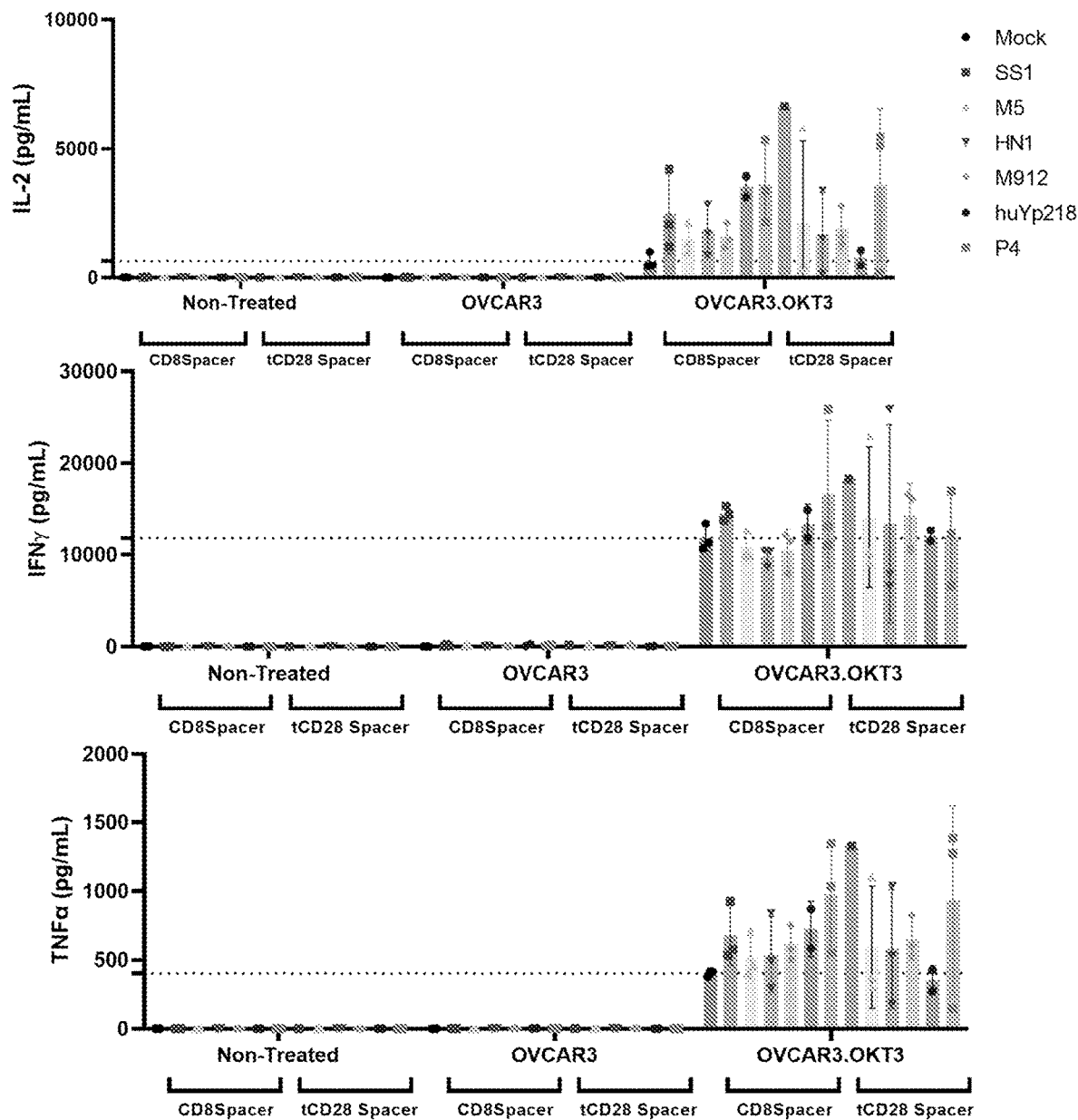
Figure 69B:
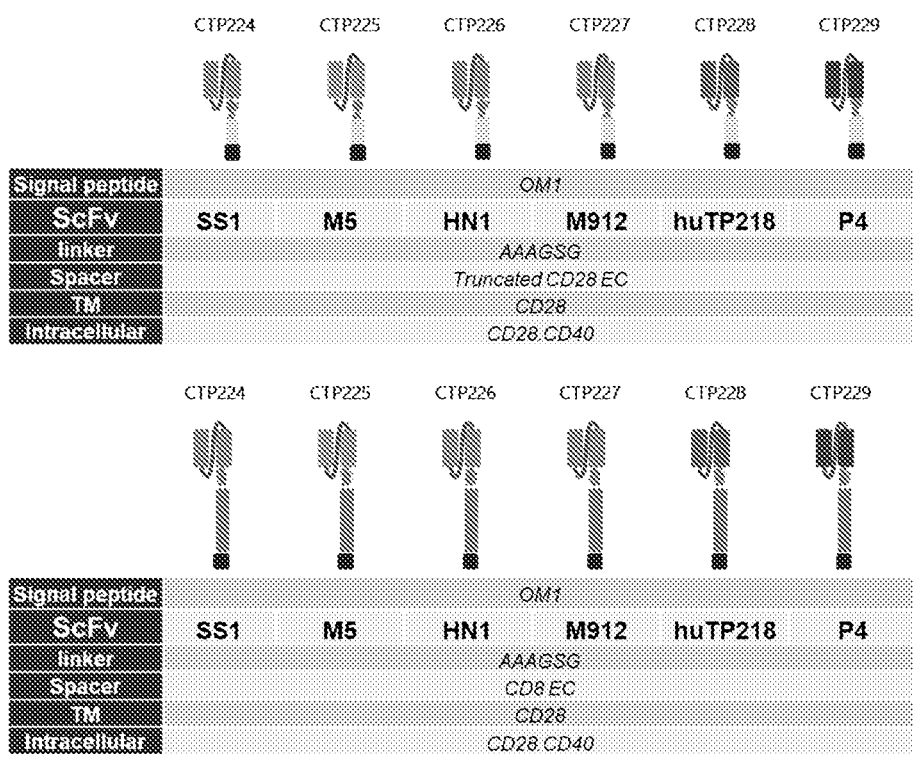

FIG. 67 depicts an experimental plan where donor PBMCs were transduced with a lentivirus for 1 of the 6 MSLN targeting CoStARs. Transduced cells were allowed outgrowth, followed by CD34 selection and a 12 day REP, followed by co-culture with the naturally MSLN and OKT3 expressing Ovcar3 cell line, where cytokine release by CoStAR expressing cells was evaluated FIG. 68 depicts the gating strategy and MSNL detection on OVCAR-3 and OVCAR-3-OKT3 detection using flow cytometry. The cells were stained using an anti-MSNL APC antibody FIG. 69A-69B depicts cytokine expression in HD T cells transduced with scFV anti-MSLN CoStARs and cocultured with K562 cell lines. The assessed constructs varied in the scFV and the spacer domains as shown below. Frequency of IL-2, IFNγ, and TNFα expressing cells is shown following cocultures with OVCAR-3 (signal 2) or OVCAR-3-OKT3 (signal 1+2) cell lines. Non-treated T cells were used as a control. The results represent 3 biological replicates.

Figure 70A:
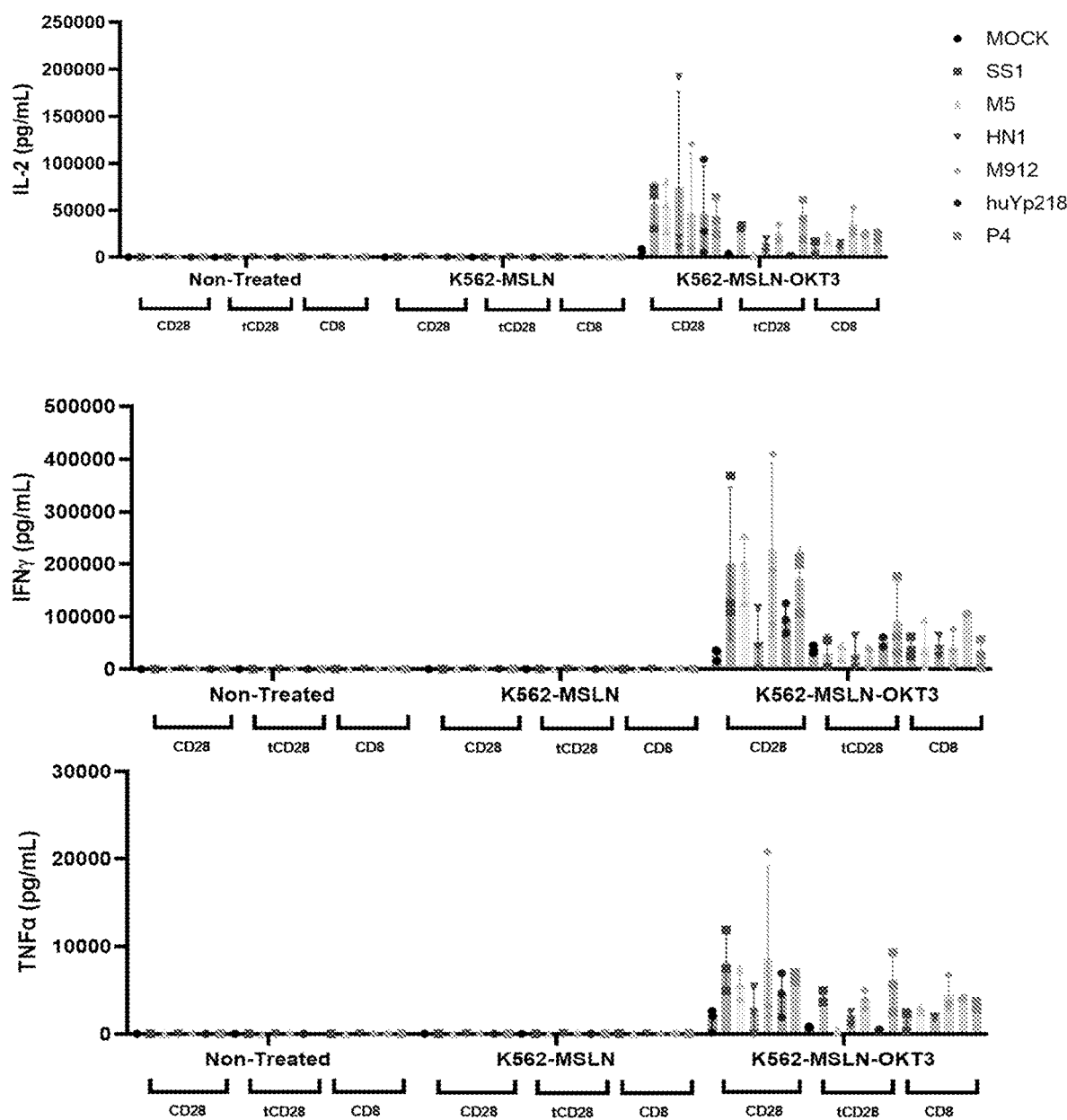
Figure 70B:
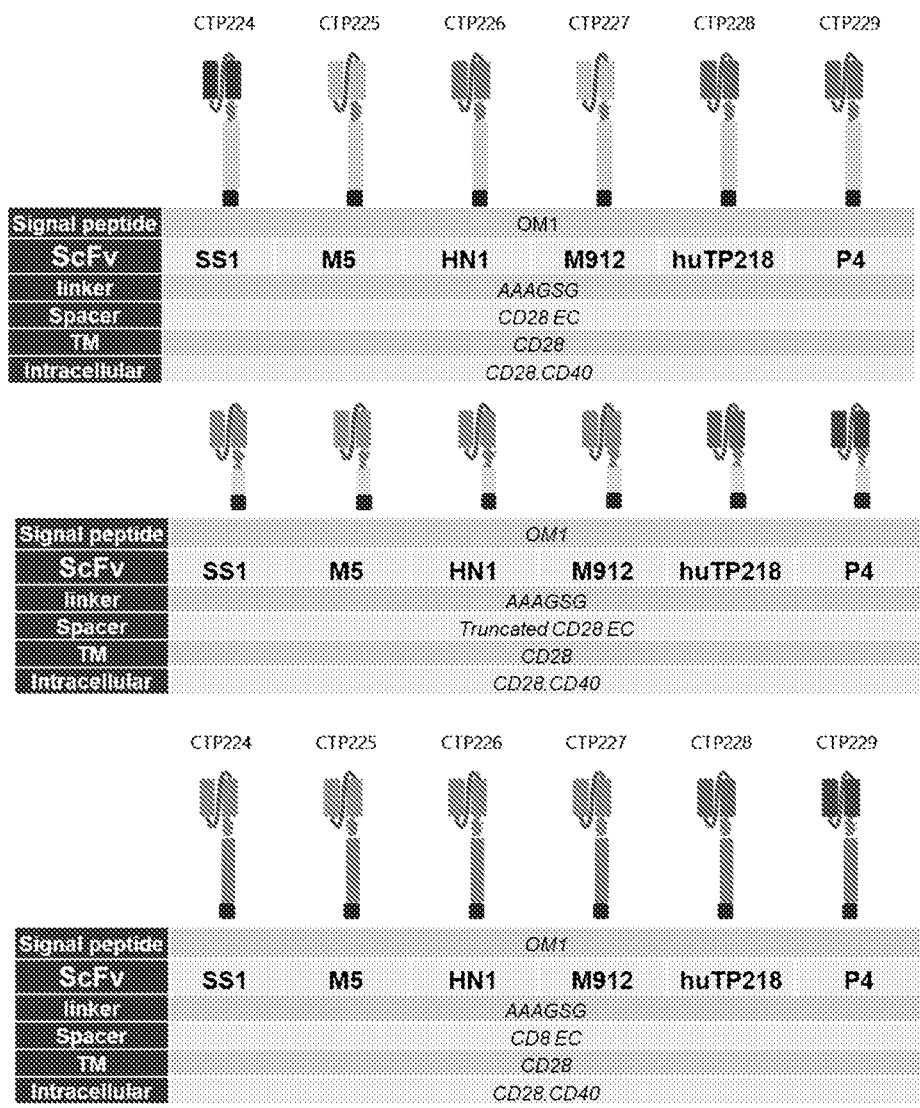

FIG. 70A-70B depicts cytokine expression in HD T cells transduced with scFV anti-MSLN CoStARs and cocultured with K562 cell lines. The assessed constructs varied in the scFV and the spacer domains as shown above. Frequency of (A) IL-2, (B) IFNγ, and (C) TNFα expressing cells is shown following cocultures with K562.MSNL (signal 2) or K562.MSNL.OKT3 (signal 1+2) cell lines. Non-treated T cells were used as a control. The results represent 3 biological replicates.

Figure 71:
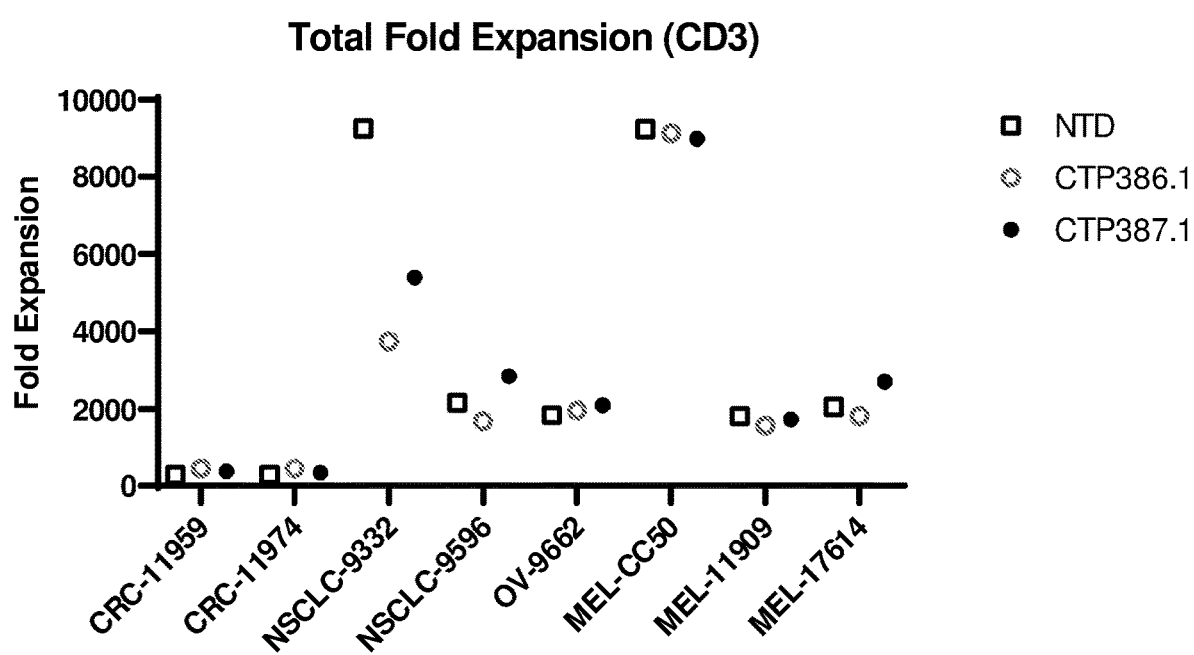

FIG. 71 depicts fold expansion of unmodified and anti-CEA CoStAR modified TILs at the end of manufacture for two CoStAR constructs.

Figure 72:
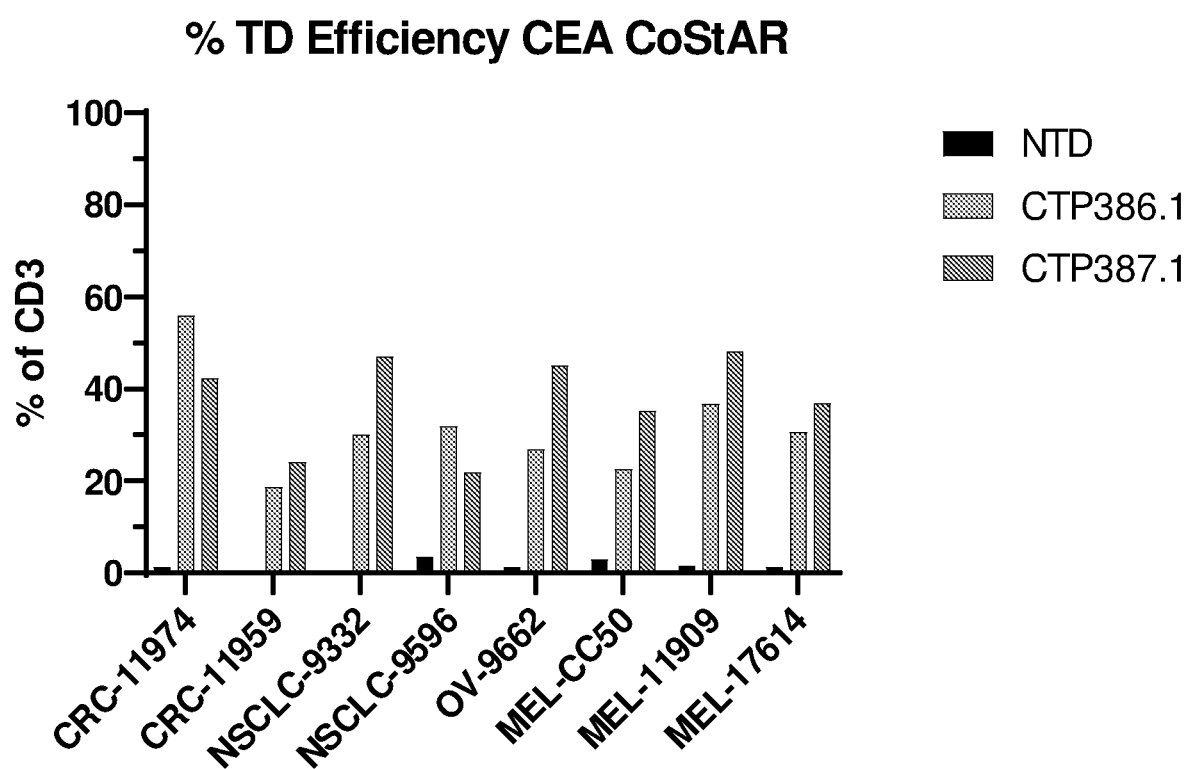

FIG. 72 depicts transduction efficiency of TILs with two anti-CEA CoStAR constructs at the end of manufacture (Day 21).

Figure 73:
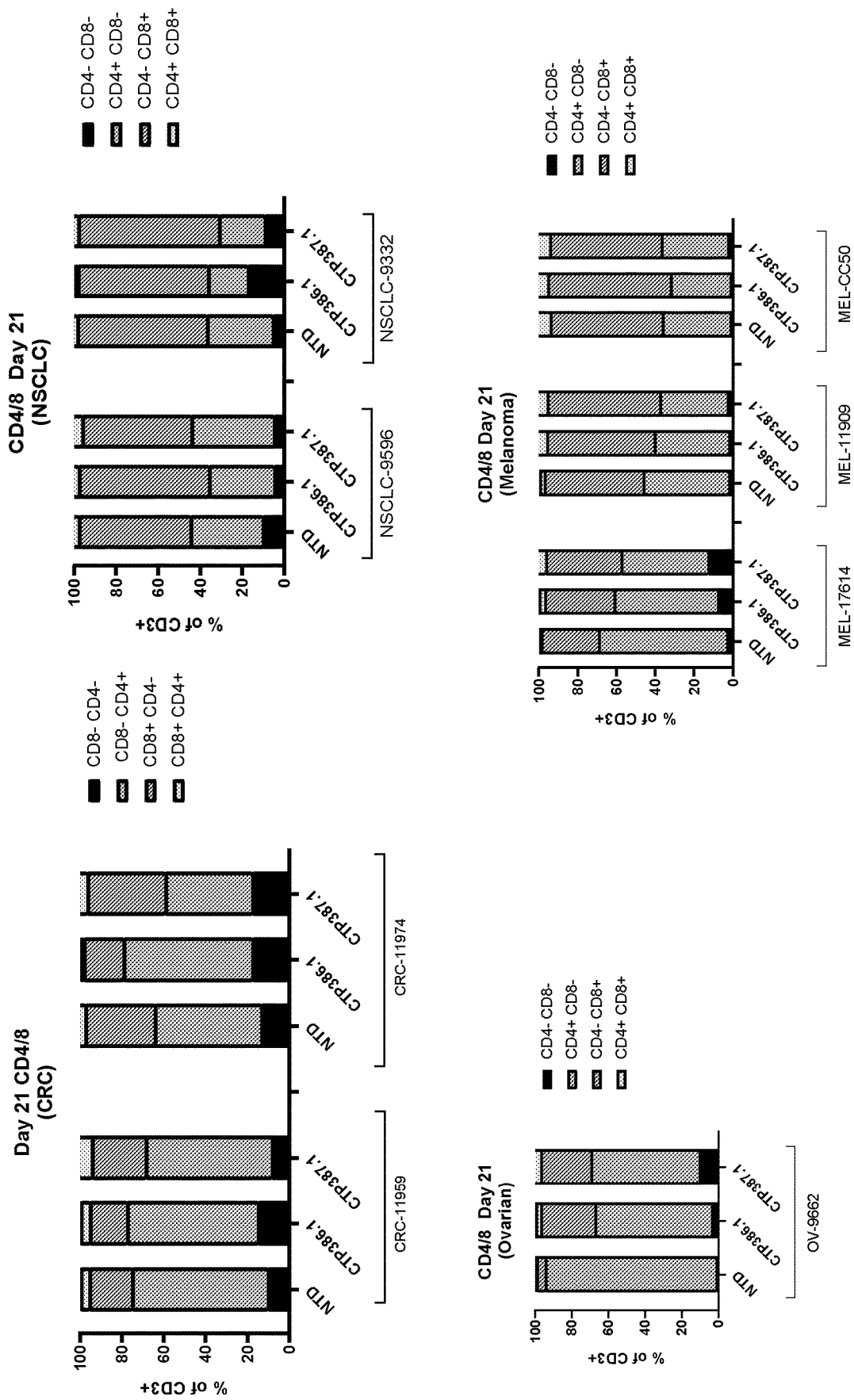

FIG. 73 depicts transduction efficiency of TILs generated from CRC, NSCLC, ovarian tumors, and melanoma with two anti-CEA CoStAR constructs at the end of manufacture (Day 21).

Figure 74:
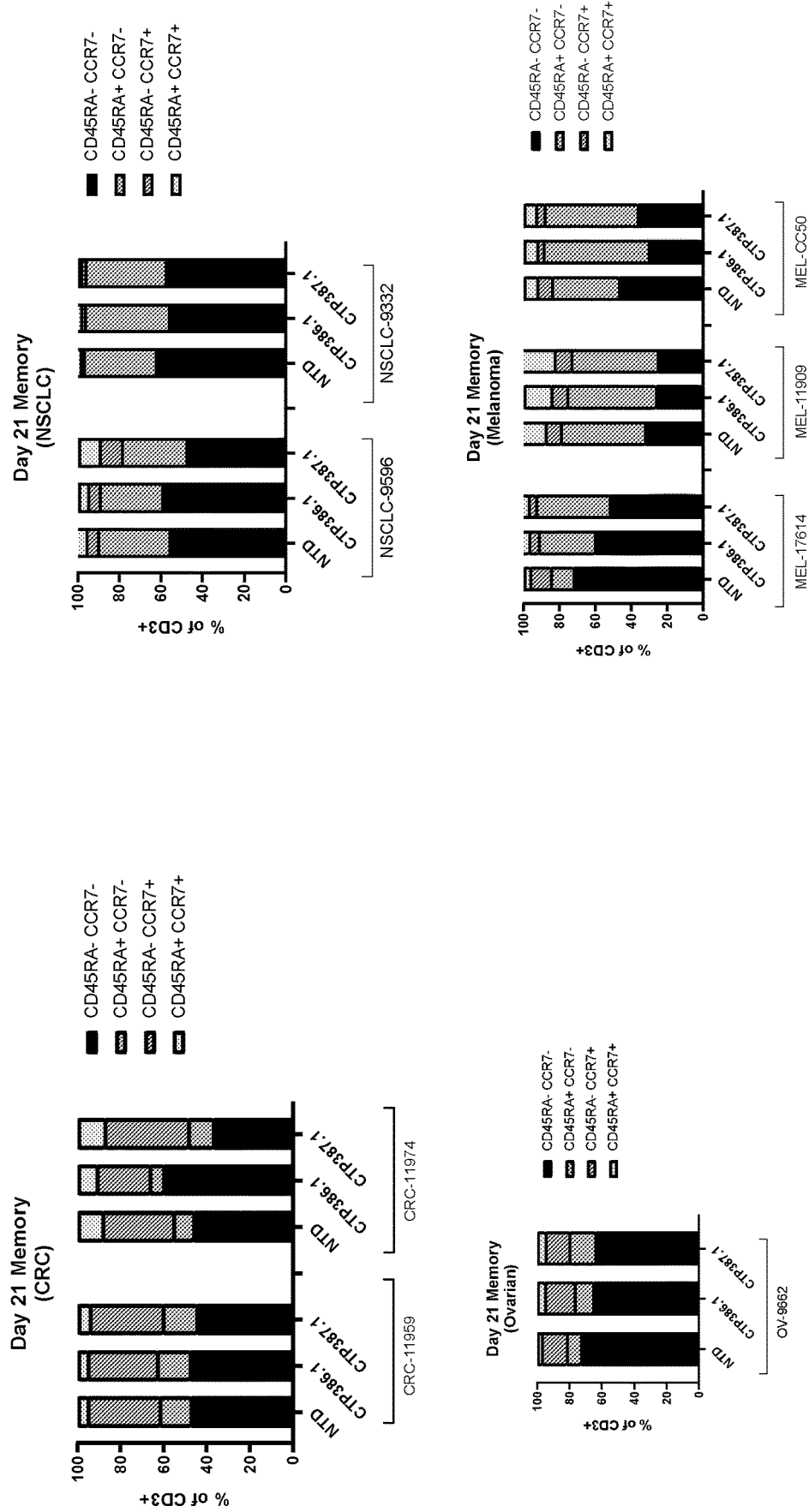

FIG. 74 depicts memory phenotype of TILs generated from CRC, NSCLC, ovarian tumors, and melanoma and transduced with two anti-CEA CoStAR constructs at the end of manufacture (Day 21).

Figure 75:
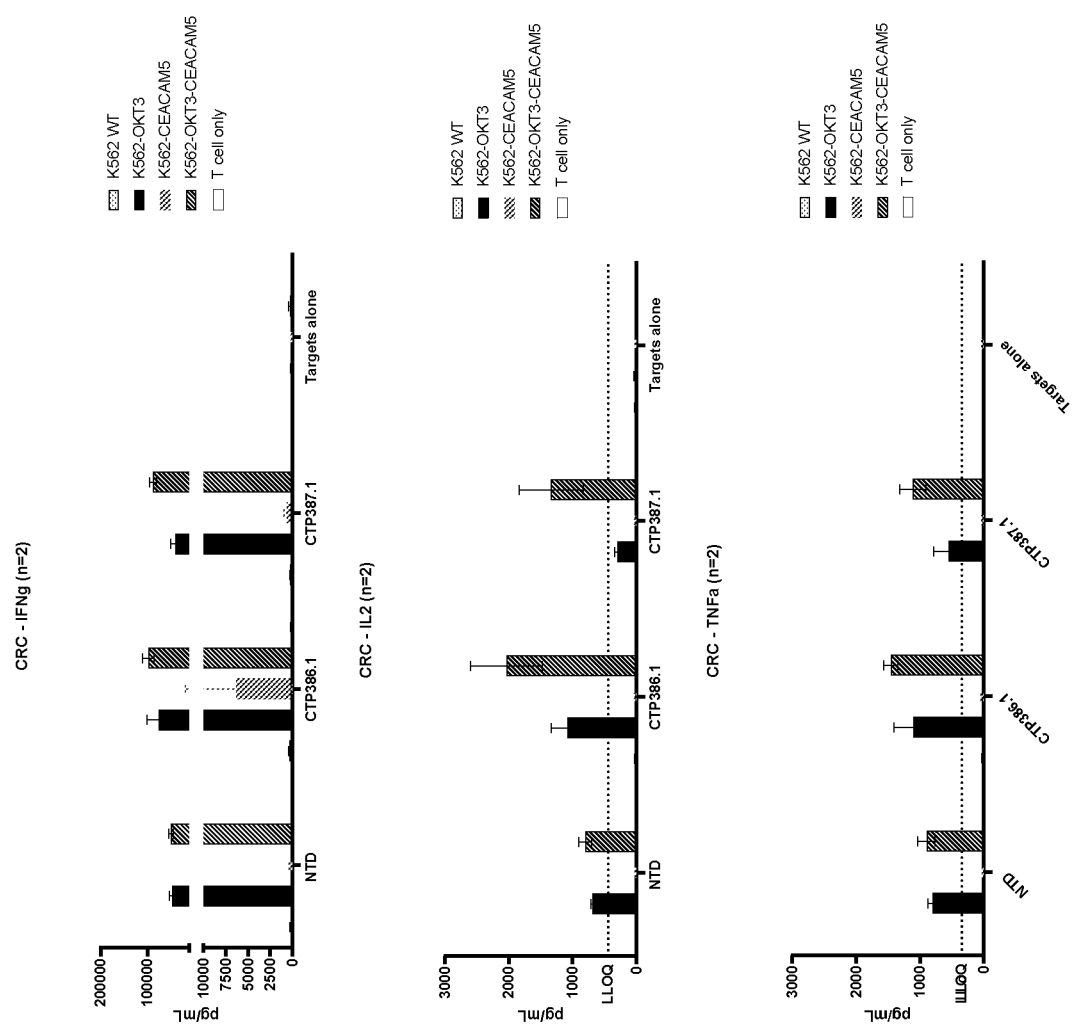

FIG. 75 depicts cytokine expression in TILs derived from CRC tumors transduced with two anti-CEA CoStAR constructs and incubated with target cells K562, K652-OKT3, K562-CEACAM5, K562-OKT3-CEACAM5, or T cells alone.

Figure 76:
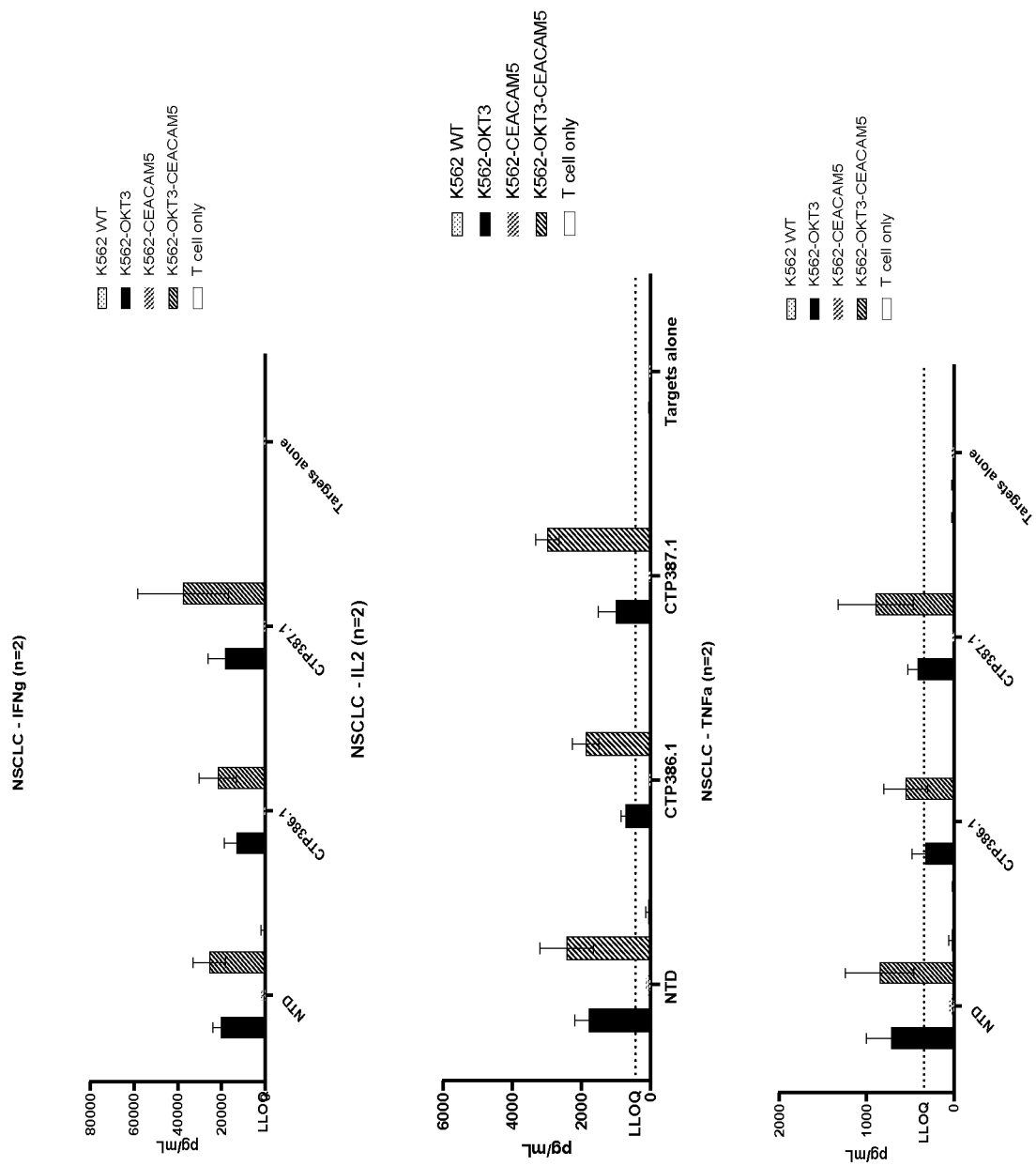

FIG. 76 depicts cytokine expression in TILs derived from NSCLC tumors transduced with two anti-CEA CoStAR constructs and incubated with target cells K562, K652-OKT3, K562-CEACAM5, K562-OKT3-CEACAM5, or T cells alone.

Figure 77:
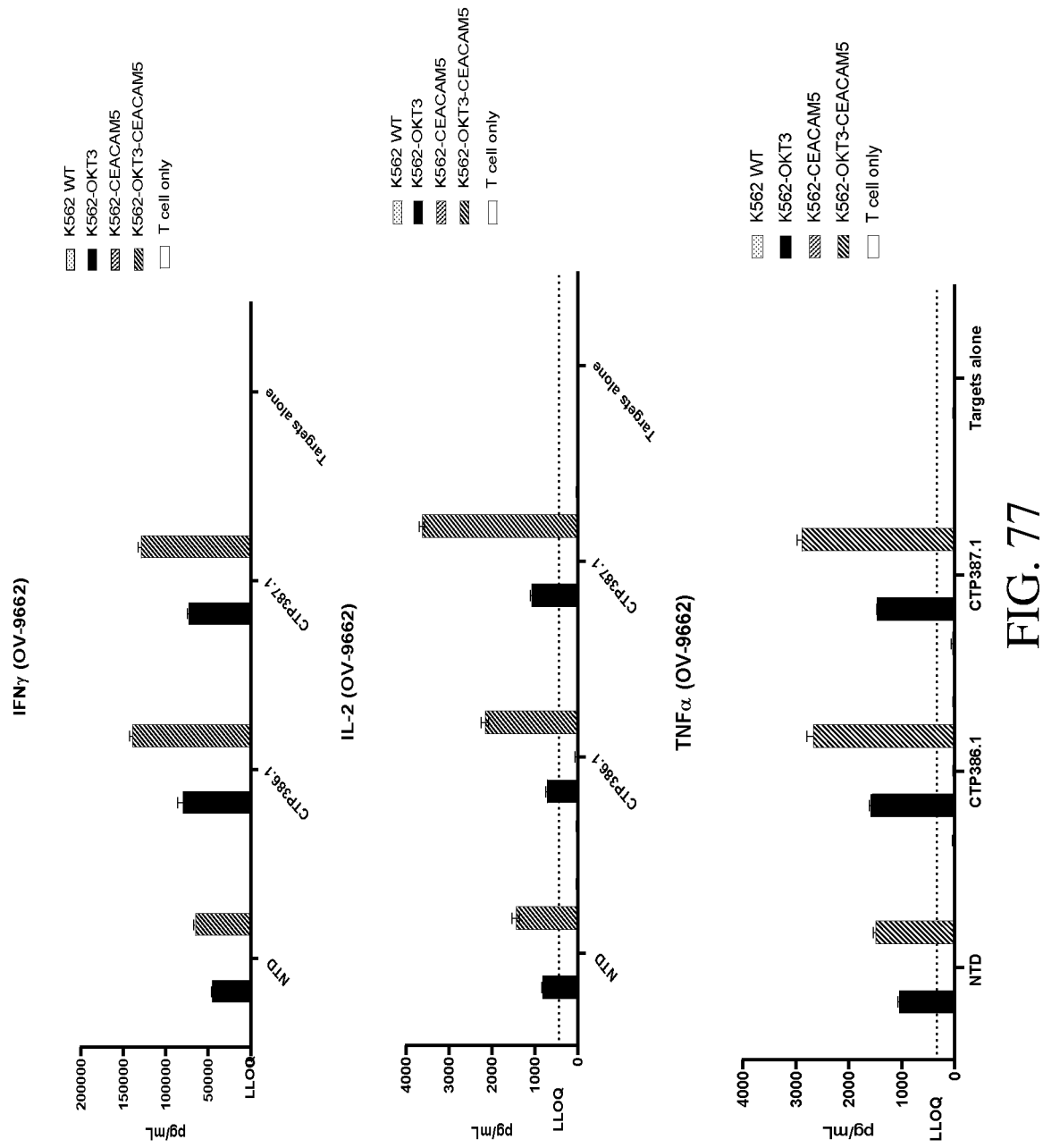

FIG. 77 depicts cytokine expression in TILs derived from OV-9662 cells and melanoma transduced with two anti-CEA CoStAR constructs and incubated with target cells K562, K652-OKT3, K562-CEACAM5, K562-OKT3-CEACAM5, or T cells alone.

Figure 78:
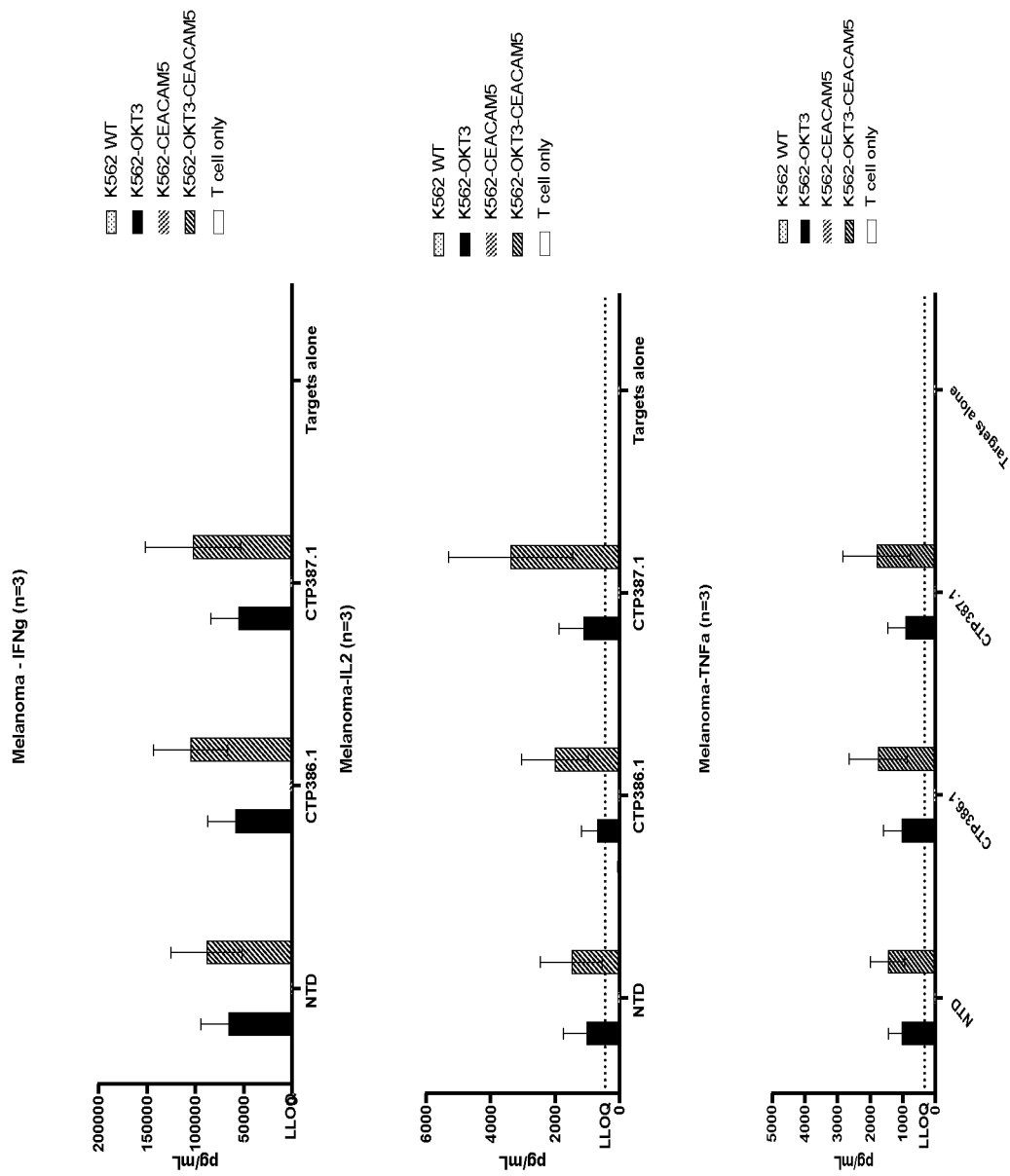

FIG. 78 depicts cytokine expression in TILs derived from melanoma cells transduced with two anti-CEA CoStAR constructs and incubated with target cells K562, K652-OKT3, K562-CEACAM5, K562-OKT3-CEACAM5, or T cells alone.

Figure 79:
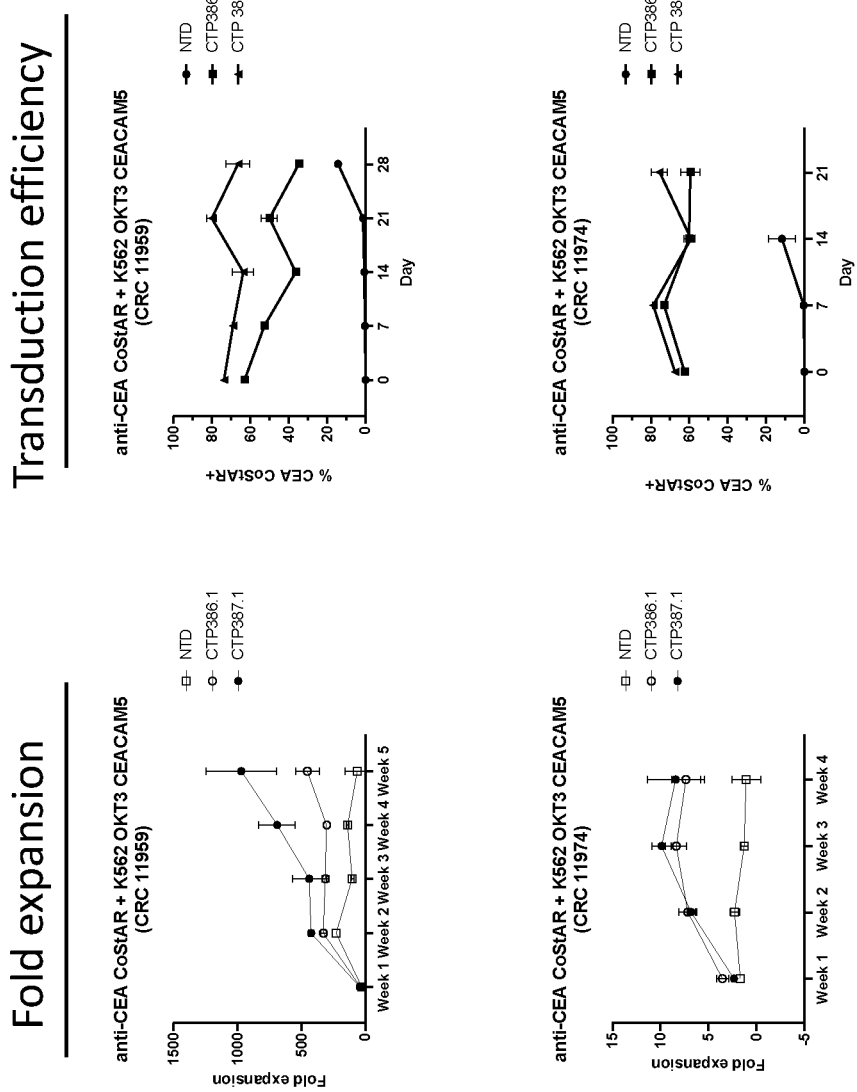

FIG. 79 depicts fold expansion and transduction efficiency in CRC11959 cells transduced with 1 of 2 anti-CEA CoStAR constructs and subsequently incubated with K562-OKT3-CEACAM5 cells. Fold expansion was evaluated from 1-4 or 1-6 weeks. Transduction efficiency was evaluated from 0-21 or 0-28 days.

Figure 80:
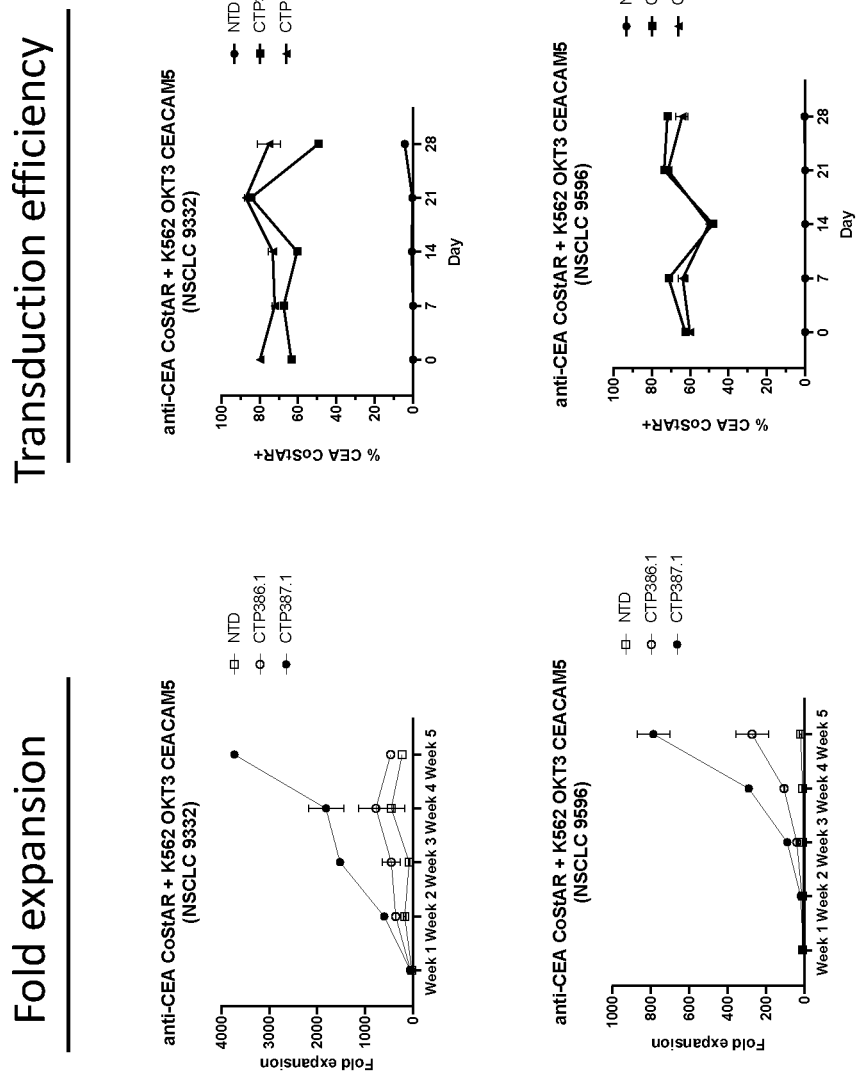

FIG. 80 depicts fold expansion and transduction efficiency in NSCLC 9332 cells transduced with 1 of 2 anti-CEA CoStAR constructs and subsequently incubated with K562-OKT3-CEACAM5 cells. Fold expansion was evaluated from 1-6 weeks. Transduction efficiency was evaluated from 0-28 days.

Figure 81:
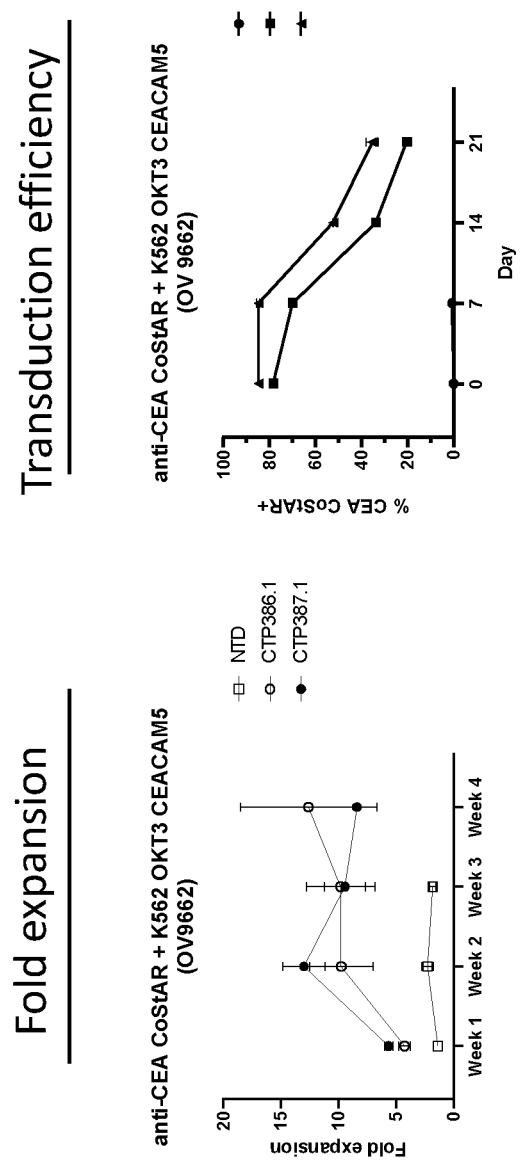

FIG. 81 depicts fold expansion and transduction efficiency in OV 9662 cells transduced with 1 of 2 anti-CEA CoStAR constructs and subsequently incubated with K562-OKT3-CEACAM5 cells. Fold expansion was evaluated from 1-4 weeks. Transduction efficiency was evaluated from 0-21 days.

FIG. 82 depicts fold expansion and transduction efficiency in Mel CC50, Mel 11909, and Mel 17614 cells transduced with 1 of 2 anti-CEA CoStAR constructs and subsequently incubated with K562-OKT3-CEACAM5 cells. Fold expansion was evaluated from 1-4 weeks. Transduction efficiency was evaluated from 0-21 days.

FIG. 83 depicts the amino acid sequences comprising the CEA.ICOS.CD40 CoStAR.

FIG. 84A-84C depicts the amino acid sequences comprising the MSLN targeting CoStARs CTP224-CTP229 as well as the MSLN targeting scFv sequences for SS1, M5, HN1, M912, huYP218, and P4.

DETAILED DESCRIPTION

Costimulatory receptors comprising a CD40 signaling domain display novel and improved activity profiles. The activity profiles can be modulated by selecting an intracellular domain of a receptor protein for joining to the CD40 signaling domain and/or by selecting elements of the CD40 signaling domains to join to the intracellular domain of a receptor protein. Provided herein are recombinant costimulatory antigen receptors (CoStARs) comprising: (i) a disease- or tumor-associated antigen binding domain, (ii) a first intracellular segment comprising an intracellular signaling domain of a receptor protein, and (iii) a second intracellular signaling domain of a CD40 receptor protein or signal transducing fragment thereof. Optionally, the CoStAR comprises an extracellular segment of a stimulatory receptor protein. In some embodiments, the extracellular segment of the stimulatory receptor protein is capable of binding ligand. In some embodiments, the extracellular segment of a stimulatory receptor protein is truncated and does not bind ligand. In some embodiments the extracellular segment of the stimulatory receptor protein operates as an adjustable length spacer allowing the disease- or tumor-associated antigen binding domain to be located away from the surface of the cell in which it is expressed for example to form a more optimal immune synapse. In some embodiments, the extracellular segment of a stimulatory receptor protein and the first intracellular segment comprise segments of the same receptor protein. In some embodiments, the extracellular segment and the first intracellular segment comprise segments of different receptor proteins. The CoStARs comprise an intervening transmembrane domain between the disease or tumor antigen binding domain and the first intracellular domain. When an extracellular segment of a stimulatory receptor protein is present, the transmembrane domain is intervening between the extracellular segment and the first intracellular signaling domain.

In some embodiments, the MSLN targeting CoStAR comprises an h-oncostatin-M signal peptide, a scFv, a linker, a spacer, a transmembrane domain, and an CD28.CD40 intracellular signaling domain. In some embodiments, the fusion protein comprises one or more of: an h-oncostatin-M signal peptide, a scFv, a linker, a spacer, a transmembrane domain, and an CD28.CD40 intracellular signaling domain.

In some embodiments the MSLN targeting CoStAR and/or fusion protein comprises SEQ ID NO: 192, 210, 228, 246, 264, or 282. In some embodiments the MSLN targeting CoStAR and/or fusion protein comprises the first sequence of SEQ ID NO: 1, connected to the second sequence of any one of SEQ ID NO: 185-191 connected to the third sequence of SEQ ID NO: 18, connected to the fourth sequence of SEQ ID NO: 19, connected to the fifth sequence of SEQ ID NO: 25, connected to the sixth sequence of SEQ ID NO: 32. See FIG. 84 for sequences.

In some embodiments, the CEA targeting CoStAR comprises an h-oncostatin-M signal peptide, a scFv, a linker, an ICOS domain, and an CD40 intracellular signaling domain. In some embodiments, the fusion protein comprises one or more of: an h-oncostatin-M signal peptide, a scFv, a linker, an ICOS domain, and an CD40 intracellular signaling domain.

In some embodiments the CEA targeting CoStAR and/or fusion protein comprises SEQ ID NO: 348. In some embodiments the CEA targeting CoStAR and/or fusion protein comprises the first sequence of SEQ ID NO: 1, connected to the second sequence SEQ ID NO: 12 connected to the third sequence of SEQ ID NO: 18, connected to the fourth sequence of SEQ ID NO: 515, connected to the fifth sequence of SEQ ID NO: 32. See FIG. 83 for sequences.

In some embodiments, the CoStAR (and/or fusion protein) comprises the MSLN scFv of one or more of the following: SS1, MNS, HN1, M912, huTP218, or P4 (e.g., as depicted in FIG. 84). In some embodiments, the linker, spacer, transmembrane domain, and intracellular domain are shared across different CoStARs. In some embodiments, changing the MSLN scFv does not affect expression of the CoStAR.

In some embodiments the CoStAR (and/or fusion protein) comprises a MSLN targeting scFv. In some embodiments the MSLN targeting CoStAR (and/or fusion protein) comprises signal peptide, a scFv and an intracellular signaling domain. In some embodiments the domains of the MSLN targeting CoStAR (and/or fusion protein) are connected via linker sequences. In some embodiments the MSLN targeting CoStAR (and/or fusion protein) comprises a hOncostatin-M signal peptide and an intracellular CD28-CD40 domain. In some embodiments the MSLN targeting domain comprises any of SS1, M5, HN1, M912, huTP218, or P4 scFvs, comprising SEQ ID NO: 186-191 in FIG. 84. In some embodiments the MSLN targeting CoStAR (and/or fusion protein) further comprises a linker with the sequence AAAGSG between the scFv and spacer. In some embodiments the spacer is a CD28EC spacer. In some embodiments the MSLN targeting CoStAR (and/or fusion protein) further comprises a CD28 transmembrane domain.

In some embodiments, the MSLN targeting CoStAR (and/or fusion protein) is comprised of a sequence with 75% identity to the polypeptide in SEQ ID NO: 192, 210, 228, 246, 264, or 282 in FIG. 84. In some embodiments, the MSLN targeting CoStAR (and/or fusion protein) is comprised of a sequence with 80% identity to the polypeptide in SEQ ID NO: 192, 210, 228, 246, 264, or 282 in FIG. 84. In some embodiments, the MSLN targeting CoStAR (and/or fusion protein) is comprised of a sequence with 85% identity to the polypeptide in SEQ ID NO: 192, 210, 228, 246, 264, or 282 in FIG. 84. In some embodiments, the MSLN targeting CoStAR (and/or fusion protein) is comprised of a sequence with 90% identity to the polypeptide in SEQ ID NO: 192, 210, 228, 246, 264, or 282 in FIG. 84. In some embodiments, the MSLN targeting CoStAR (and/or fusion protein) is comprised of a sequence with 95% identity to the polypeptide in SEQ ID NO: 192, 210, 228, 246, 264, or 282 in FIG. 84. In some embodiments, the MSLN targeting CoStAR (and/or fusion protein) in SEQ ID NO: 192, 210, 228, 246, 264, or 282 in FIG. 84 has 1 point mutation. In some embodiments, the MSLN targeting CoStAR (and/or fusion protein) in SEQ ID NO: 192, 210, 228, 246, 264, or 282 in FIG. 84 has 2 point mutations. In some embodiments, the MSLN targeting CoStAR (and/or fusion protein) in SEQ ID NO: 192, 210, 228, 246, 264, or 282 in FIG. 84 has 3, 4, or 5 point mutations.

In some embodiments, the MSLN targeting domain of the construct comprises a SS1, M5, HN1, M912, huTP218, or P4 scFv, comprising a sequence with at least 75% identity to the polypeptide in SEQ ID NO: 186-191 in FIG. 84. In some embodiments, the MSLN targeting domain comprises a SS1, M5, HN1, M912, huTP218, or P4 scFv, comprising a sequence with at least 80% identity to the polypeptide in SEQ ID NO: 186-191 in FIG. 84. In some embodiments, the MSLN targeting domain comprises a SS1, M5, HN1, M912, huTP218, or P4 scFv, comprising a sequence with at least 85% identity to the polypeptide in SEQ ID NO: 186-191 in FIG. 84. In some embodiments, the MSLN targeting domain comprises a SS1, M5, HN1, M912, huTP218, or P4 scFv, comprising a sequence with at least 90% identity to the polypeptide in SEQ ID NO: 186-191 in FIG. 84. In some embodiments, the MSLN targeting domain comprises a SS1, M5, HN1, M912, huTP218, or P4 scFv, comprising a sequence with at least 95% identity to the polypeptide in SEQ ID NO: 186-191 in FIG. 84. In some embodiments, the MSLN targeting scFV in SEQ ID NO: 186-191 in FIG. 84 has 1 point mutation. In some embodiments, the MSLN targeting scFV in SEQ ID NO: 186-191 in FIG. 84 has 2 point mutations. In some embodiments, the MSLN targeting scFV in SEQ ID NO: 186-191 in FIG. 84 has 3, 4, or 5 point mutations.

In some embodiments the CoStAR (and/or fusion protein) comprises a CEA.ICOS.CD40 arrangement. In some embodiments the CEA.ICOS.CD40 CoStAR (and/or fusion protein) comprises signal peptide, a scFv and an intracellular signaling domain. In some embodiments the domains of the CEA.ICOS.CD40 CoStAR (and/or fusion protein) are connected via linker sequences. In some embodiments the CEA.ICOS.CD40 CoStAR (and/or fusion protein) comprises a hOncostatin-M signal peptide, humanized MFE23 VH and VL, human ICOS Q9Y6W8, and a human intracellular CD40 domain. In some embodiments the CEA.ICOS.CD40 CoStAR (and/or fusion protein) further comprises a 3×G4S linker between the VH and VL. In some embodiments the CEA.ICOS.CD40 CoStAR (and/or fusion protein) further comprises a linker with the sequence AAAGSGGSG between the VL and ICOS domain.

In some embodiments, any of the sequence components in any of the figures and/or tables (such as table 7) can be combined into any of the CoStAR arrangements provided herein (such as a binding domain, TM, ICOS or CD28 domain, and CD40 domain (with other optional spacers and/or linkers). In some embodiments, any of the sequence components in any of the figures and/or tables (such as table 7) can be combined into any of the fusion protein arrangements provided herein. Such fusion proteins can include the amino acid sequences as provided herein. In some embodiments, the CoStARs and/or fusion proteins are at least 70, 75, 80, 85, 90, 95, 96, 97, 98, 99, or 100% identical to any one ore more of the amino acid sequences provided herein, including any range between any two of the preceeding values.

In some embodiments, the CEA.ICOS.CD40 CoStAR (and/or fusion protein) is comprised of a sequence with at least 75% identity to the polypeptide in SEQ ID NO: 348 in FIG. 83. In some embodiments, the CEA.ICOS.CD40 CoStAR (and/or fusion protein) is comprised of a sequence with at least 80% identity to the polypeptide in SEQ ID NO: 348 in FIG. 83. In some embodiments, the CEA.ICOS.CD40 CoStAR (and/or fusion protein) is comprised of a sequence with at least 85% identity to the polypeptide in SEQ ID NO: 348 in FIG. 83. In some embodiments, the CEA.ICOS.CD40 CoStAR (and/or fusion protein) is comprised of a sequence with at least 90% identity to the polypeptide in SEQ ID NO: 348 in FIG. 83. In some embodiments, the CEA.ICOS.CD40 CoStAR (and/or fusion protein) is comprised of a sequence with at least 95% identity to the polypeptide in SEQ ID NO: 348 in FIG. 83. In some embodiments, the CEA.ICOS.CD40 CoStAR (and/or fusion protein) in SEQ ID NO: 348 in FIG. 83 has 1 point mutation. In some embodiments, the CEA.I-

COS.CD40 CoStAR (and/or fusion protein) in SEQ ID NO: 348 in FIG. 83 has 2 point mutations. In some embodiments, the CEA.ICOS.CD40 CoStAR (and/or fusion protein) in SEQ ID NO: 348 in FIG. 83 has 3, 4, or 5 point mutations.

In some embodiments, the CEA targeting domain comprises a scFv, comprising a sequence with at least 75% identity to the polypeptide in SEQ ID NO: 12 in FIG. 83. In some embodiments, the CEA targeting domain comprises a scFv, comprising a sequence with at least 80% identity to the polypeptide in SEQ ID NO: 12 in FIG. 83. In some embodiments, the CEA targeting domain comprises a scFv, comprising a sequence with at least 85% identity to the polypeptide in SEQ ID NO: 12 in FIG. 83. In some embodiments, the CEA targeting domain comprises a scFv, comprising a sequence with at least 90% identity to the polypeptide in SEQ ID NO: 12 in FIG. 83. In some embodiments, the CEA targeting domain comprises a scFv, comprising a sequence with at least 95% identity to the polypeptide in SEQ ID NO: 12 in FIG. 83. In some embodiments, the CEA targeting scFV in SEQ ID NO: 12 in FIG. 83 has 1 point mutation. In some embodiments, the CEA targeting scFV in SEQ ID NO: 12 in FIG. 83 has 2 point mutations. In some embodiments, the CEA targeting scFV in SEQ ID NO: 12 in FIG. 83 has 3, 4, or 5 point mutations.

In some embodiments, the the fusion protein comprises: a binding domain specific for CEA linked to; a transmembrane domain that is linked to; an ICOS domain that is linked to; a CD40 signaling domain.

In some embodiments, the fusion protein comprises: a binding domain specific for MSLN linked to; a transmembrane domain that is linked to; a CD28 domain that is linked to; a CD40 signaling domain.

In some embodiments, the fusion protein comprises: a first sequence that is at least 70% identical to SEQ ID NO: 12; a second sequence that is a transmembrane domain; a third sequence that is at least 70% identical to SEQ ID NO: 518; and a fourth sequence that is at least 70% identical to SEQ ID NO: 32.

In some embodiments, the fusion protein comprises: a first sequence that is at least 70% identical to any one of SEQ ID NO: 186-191; a second sequence that is a transmembrane domain; a third sequence that is at least 70% identical to SEQ ID NO: 25; and a fourth sequence that is at least 70% identical to SEQ ID NO: 32.

In some embodiments, the fusion protein comprises: a HCDR1 that is an HCDR1 in SEQ ID NO: 12; a HCDR2 that is an HCDR2 in SEQ ID NO: 12; a HCDR3 that is an HCDR3 in SEQ ID NO: 12; a LCDR1 that is an LCDR1 in SEQ ID NO: 12; a LCDR2 that is an LCDR2 in SEQ ID NO: 12; a LCDR3 that is an HCDR3 in SEQ ID NO: 12, wherein 1, 2, 3, 4, 5, or 6 of the LCDRs can include 1, 2, or 3 point mutations; a second sequence that is a transmembrane domain; a third sequence that is at least 70% identical to SEQ ID NO: 515; and a fourth sequence that is at least 70% identical to SEQ ID NO: 32.

In some embodiments, the fusion protein further comprises a signal peptide sequence that is at least 70% identical to SEQ ID NO: 1.

In some embodiments, the fusion protein further comprises a linker sequence that is at least 70% identical to SEQ ID NO: 18.

In some embodiments, the fusion protein further comprises an ICOS sequence that is at least 70% identical to SEQ ID NO: 515.

In some embodiments, the fusion protein further comprises an CD40 sequence that is at least 70% identical to SEQ ID NO: 32.

In some embodiments, the fusion protein comprises: a HCDR1 that is an HCDR1 in SEQ ID NOs: 186-191; a HCDR2 that is an HCDR2 in SEQ ID NOs: 186-191; a HCDR3 that is an HCDR3 in SEQ ID NOs: 186-191; a LCDR1 that is an LCDR1 in SEQ ID NOs: 186-191; a LCDR2 that is an LCDR2 in SEQ ID NOs: 186-191; a LCDR3 that is an HCDR3 in SEQ ID NOs: 186-191, wherein 1, 2, 3, 4, 5, or 6 of the LCDRs can include 1, 2, or 3 point mutations; a second sequence that is a transmembrane domain; a third sequence that is at least 70% identical to SEQ ID NO: 25; and a fourth sequence that is at least 70% identical to SEQ ID NO: 32.

In some embodiments, the fusion protein further comprises an CD28 TM sequence that is at least 70% identical to SEQ ID NO: 19.

In some embodiments, the fusion protein further comprises an CD28 sequence that is at least 70% identical to SEQ ID NO: 25.

As used herein, "full length protein" or "full length receptor" refers to a receptor protein, such as, for example, a CD28 receptor protein. The term "full length" encompasses receptor proteins lacking up to about 5 or up to 10 amino acids, for example 1, 2, 3, 4, 5, 6, 7, 8, 9, or 10 amino acids, at the N-terminal of the mature receptor protein once its signal peptide has been cleaved. For instance, while a specific cleavage site of a receptors N-terminal signal peptide may be defined, variability in exact point of cleavage has been observed. The term "full length" does not imply presence or absence of amino acids of the receptors N-terminal signal peptide. In one embodiment, the term "full length" (e.g. a full length CD28 or a full length CD40 intracellular domain, according to some embodiments) encompasses mature receptor proteins (e.g. CD28 according to some embodiments) lacking the N terminal signal peptide lacking up to about 5, for example 1, 2, 3, 4, 5, or up to 10 amino acids at the N-terminal of the mature receptor protein once its signal peptide has been cleaved. As mentioned above, a "full length" CD28 receptor or other receptor or tumor antigen binding domain according to some embodiments does not include the signal peptide and may lack up to about 5, for example 1, 2, 3, 4, 5, or up to 10 amino acids at the N-terminal of the mature receptor protein (e.g. N terminal residues N, K, I, L and/or V). This is shown in the exemplary fusions, e.g. SEQ ID Nos. 433-441 (note that these may lack up to about 5, for example 1, 2, 3, 4, 5, or up to 10 amino acids at the N-terminal of the mature receptor protein as shown in the boxed region).

CoStARs have modular form and can be constructed to comprise extracellular, transmembrane and intracellular domains obtained from a one or more proteins, along with the scFv obtained from an antibody that binds to a disease-associated antigen, for example, a tumor associated antigen.

In some embodiments, a CoStAR comprises a disease-associated, for example a tumor-associated, antigen receptor, such as but not limited to a tumor-associated antigen specific scFv, and a primary costimulatory receptor protein that is capable of binding to its cognate ligand and providing an intracellular signal. In some embodiments, the primary costimulatory receptor can be less than a full length protein but is sufficient to bind cognate ligand and transduce a signal. In some embodiments, the primary costimulatory receptor domain is full length, such as but not limited to, full length CD28. Thus, both the antigen specific binding domain and the ligand specific receptor are capable of binding cognate antigen and ligand respectively. The amino acid sequences provided herein provide embodiments of several CoStARs constructs. These include CoStARs constructs that comprise an antigen binding domain, an optional spacer, an optional costimulatory receptor protein comprising an extracellular ligand binding segment or fragment thereof and intracellular CD40 signaling domain. In another embodiment, a CoStAR comprises an antigen binding domain, an optional spacer, an extracellular ligand-binding portion of a costimulatory receptor protein, a transmembrane domain, and an intracellular signaling domain of a selected costimulatory receptor protein and intracellular CD40 signaling domain. In some embodiments, the extracellular ligand-binding portion comprises a CD28 truncation, for example, a C-terminal CD28 truncation after amino acids IEV, and is followed by an intracellular signaling domain. In some embodiments, the intracellular signaling domain is from CD40. The transmembrane domain separating the extracellular ligand-binding and intracellular signaling domains can be from, with limitation, CD28, CD40. In further embodiments, CoStARs can comprise additional costimulatory domains, for example a third, intracellular costimulatory signaling domain and in this respect may be similar to certain chimeric antigen receptors (CARs), which have been classified into first (CD3ζ only), second (one costimulatory domain+CD3ζ), or third generation (more than one costimulatory domain+CD3ζ).

Costimulatory receptor proteins useful in CoStARs can include, without limitation, CD2, CD9, CD26, CD27, CD28, CD29, CD38, CD40, CD43, CD46, CD49d, CD55, CD73, CD81, CD82, CD99, CD100, CD134 (OX40), CD137 (41BB), CD150 (SLAM), CD270 (HVEM), CD278 (ICOS), CD357 (GITR), or EphB6, which in their natural form comprise extracellular ligand binding domains and intracellular signal transducing domains. For example, CD2 is characterized as a cell adhesion molecule found on the surface of T cells and is capable of initiating intracellular signals necessary for T cell activation. CD27 is characterized as a type II transmembrane glycoprotein belonging to the TNFR superfamily (TNFRSF) whose expression on B cells is induced by antigen-receptor activation in B cells. CD28 is one of the proteins on T cells and is the receptor for CD80 (B7.1) and CD86 (B7.2) ligands on antigen-presenting cells. CD137 (4-1BB) ligand is found on most leukocytes and on some non-immune cells. OX40 ligand is expressed on many antigen-presenting cells such as DC2s (dendritic cells), macrophages, and B lymphocytes. In one embodiment, the costimulatory receptor protein is full length CD28 as defined herein.

CD40 is a member of the tumor necrosis factor receptor (TNFR) superfamily and several isoforms are generated by alternative splicing. Its ligand, CD154 (also called CD40L) is a protein that is primarily expressed on activated T cells. For reference, the human CD40 isoform 1 protein sequence is set forth in GenBank accession No. NP_001241.1, including signal peptide (amino acids 1-20), transmembrane domain (amino acids 194-215), and cytoplasmic domain (amino acids 216-277)(SEQ ID NO:32). CD40 receptor signaling involves adaptor proteins including but not limited to TNF receptor-associated factors (TRAF), and the CD40 cytoplasmic domain comprises signaling components, including amino acid sequences fitting an SH3 motif (KPTNKAPH) (SEQ ID NO:35), TRAF2 motif (PKQE (SEQ ID NO:36), PVQE (SEQ ID NO:37), SVQE (SEQ ID NO:38)), TRAF6 motif (QEPQEINFP) (SEQ ID NO:39) and PKA motif (KKPTNKA (SEQ ID NO:40), SRISVQE (SEQ ID NO:41)). Some embodiments include engineered signaling domains, such as engineered CD40 signaling domains, comprising TRAF-binding amino acid sequences. Engineered signaling domains that bind to TRAF1, TRAF2, TRAF3, and TRAF5 may comprise the major consensus sequence (P/S/A/T)X(Q/E)E or minor consensus sequence PXQXXD and can be identified in or obtained from, without limitation, TNFR family members such as CD30, OX40, 41BB, and the EBV oncoprotein LMPI. (See, e.g., Ye, H et al., *The Structural Basis for the Recognition of Diverse Receptor Sequences by TRAF2*. Molecular Cell, 1999; 4(3): 321-30. doi: 10.1016/S1097-2765(00)80334-2; Park H H, *Structure of TRAF Family: Current Understanding of Receptor Recognition*. Front. Immunol. 2018; 9:1999. doi: 10.3389/fimmu.2018.01999; Chung, J. Y. et al., *All TRAFs are not created equal: common and distinct molecular mechanisms of TRAF-mediated signal transduction*. Journal of Cell Science 2002; 115:679-688).

Examples disclosed herein demonstrate operation of CD40 as a costimulatory signaling domain in a CoStAR and further that cytokine and chemokine expression profiles are altered by signaling domain selection. In some embodiments, the costimulatory CD40 signaling domain of a CoStAR promotes pro-inflammatory cytokines (e.g., IL-2, TNFα). In some embodiments, the costimulatory CD40 signaling domain of a CoStAR reduces immunosuppressive cytokines (e.g., IL-5, IL-10). Costimulatory activity of a CD40 signaling domain or fragment can be observed in combination with a first receptor signaling domain such as but not limited to CD2, CD9, CD26, CD27, CD28, CD29, CD38, CD40, CD43, CD46, CD49d, CD55, CD73, CD81, CD82, CD99, CD100, CD134 (OX40), CD137 (41BB), CD150 (SLAM), CD270 (HVEM), CD278 (ICOS), CD357 (GITR), or EphB6, as compared to activity of the first receptor signaling domain without the CD40 signaling domain or fragment. In this regard, the CD40 signaling domains, including signaling fragments comprising particular factor binding sites or wherein particular factor binding sites are mutated, in combination with a costimulatory first signaling domain, are capable of promoting or suppressing relative expression of particular cytokines and/or chemokines as compared to the first signaling domain alone. activity of a costimulatory signaling domain. (See, e.g., Ahonen, C L et al., *The CD40-TRAF6 axis controls affinity maturation and the generation of long-lived plasma cells*. Nat Immunol. 2002; 3: 451-456; Mackey M F et al., *Distinct contributions of different CD40 TRAF binding sites to CD154-induced dendritic cell maturation and IL-12 secretion*. Eur J Immunol. 2003; 33: 779-789; Mukundan L et al., *TNF receptor-associated factor 6 is an essential mediator of CD40-activated proinflammatory pathways in monocytes and macrophages*. J Immunol. 2005; 174: 1081-1090.

In some embodiments, a CoStAR comprises substantially all of a CD40 costimulatory domain. In some embodiments, a CoStAR comprises two or more CD40 costimulatory domains. In some embodiments, a CoStAR comprises a CD40 costimulatory domain signaling component or fragment or motif. In some embodiments, the CD40 signaling fragment or motif comprises, consists, or consists essentially of an SH3 binding sequence (e.g., without limitation, KPTNKAPH (SEQ ID NO:35), PTNKAPHP (SEQ ID NO:443) or PTNKAPH (SEQ ID NO:444)), TRAF2/TRAF3 binding sequence (e.g., without limitation, PKQE (SEQ ID NO:506), PKQET (SEQ ID NO:445), PVQE (SEQ ID NO:507), PVQET (SEQ ID NO:446), SVQE (SEQ ID NO:508), SVQET (SEQ ID NO:447)), TRAF6 binding sequence (e.g., without limitation, PQEINF (SEQ ID NO:509), QEPQEINF (SEQ ID NO:448) or QEPQEINFP (SEQ ID NO:39)) or PKA sequence (e.g., without limitation, KKPTNKA (SEQ ID NO:40), or SRISVQE (SEQ ID NO:41) as well as two or more, or three or more, or four or more such components or motifs, or combinations thereof, which can be in multiple copies and arranged in any order. In some embodiments, a CoStAR comprises a CD40 costimulatory domain and a CD40 costimulatory domain signaling component or motif. In some embodiments, one or more of the SH3, TRAF2/TRAF3, TRAF6, or PKA motifs of the CD40 signaling domain is mutated. In some embodiments, the SH3 motif, TRAF2/TRAF3 motif, and TRAF6 motif are sufficient to modulate pro-inflammatory and/or immunosuppressive cytokines. In some embodiments, adding tandem copies of those motifs and/or mutating certain motifs amplifies these effects.

TABLE 1

Table 1 provides non-limiting examples of TRAF2/TRAF3 binding sequences.

Exemplary TRAF2/TRAF3 binding sequences

| Source | P-4 | P-3 | P-2 | P-1 | P0 | P1 | P2 | P3 | P4 | P5 | P6 | SEQ ID NO. |
|---|---|---|---|---|---|---|---|---|---|---|---|---|
| hTNFR2 | P | F | s | K | E | E | C | A | F | R | S | 450 |
| hCD40 | A | A | P | V | Q | E | T | L | H | G | C | 451 |
| hCD30 | M | L | S | V | E | E | E | G | K | E | D | 452 |
| hCD27 | T | I | P | I | Q | E | D | Y | R | K | P | 453 |
| hLTpR | S | T | P | H | Q | E | D | G | K | A | W | 454 |
| hATAR | T | V | A | V | E | E | T | I | P | S | T | 455 |
| hOX40 | R | T | P | I | Q | E | E | Q | A | D | A | 456 |
| m41BB | T | G | A | A | Q | E | E | D | A | C | S | 457 |
| m41BB | R | C | P | Q | E | E | E | G | G | G | G | 458 |
| h41BB | V | Q | T | T | Q | E | E | D | G | C | S | 459 |
| h41BB | R | F | P | E | E | E | E | G | G | C | E | 460 |
| bLMP1 | R | T | P | V | Q | E | S | G | Y | P | D | 461 |
| bLMP1 | R | P | P | V | Q | E | T | G | G | G | G | 462 |
| bLMP1 | H | P | P | V | Q | E | T | G | G | G | G | 463 |
| bLMP1 | H | P | P | V | Q | E | T | G | E | G | G | 464 |
| bLMP1 | H | P | P | I | Q | E | T | G | N | G | G | 465 |
| LAT | A | L | S | S | Q | E | A | E | E | V | E | 466 |
| hTANK | S | V | P | I | Q | C | T | D | K | T | D | 467 |
| hLMP1 | P | H | P | Q | Q | A | T | D | D | S | S | 468 |
| rLMP1 | P | Y | P | I | Q | A | T | D | G | G | N | 469 |
| rLMP1 | P | H | P | I | Q | A | T | D | G | A | N | 470 |
| rLMP1 | P | Y | P | V | Q | A | S | D | G | G | D | 471 |
| Minor Consensus | | | P/S/A/T | X | Q/E | E | | | | | | 472 |
| Major Consensus | | | P | V | Q | E | | | | | | 473 |

Accordingly, TRAF2/TRAF3 binding sequences of some embodiments further include sequences such as $P_1V_2Q_3E_4$ and variants wherein $P_1$ is substituted with S, A, or T, $V_2$ is substituted with Q, K, or E, $Q_3$ is substituted with E, and/or $E_4$ is substituted with A. In such variants, any one, two, three, or all four of $P_1V_2Q_3E_4$ may be substituted. Non-limiting examples are shown in Table 1 at positions P-2, P-1, P0, P1.

Illustrative non-limiting examples of CD40 TRAF2/TRAF3 sequence variants include the following, the amino acids at P-2, P-1, P0, and P1 enclosed by dashes, and the TRAF2/TRAF3 source protein identified.

TABLE 2

Exemplary CD40 TRAF2/TRAF3 variants

| SEQ ID NO: | Amino acid sequence based on CD40 | TRAF2/3 sequece origin |
|---|---|---|
| 474 | KKVAKKPTNKAPHPKQEPQEINFPDDLPGSNTAA--PVQE--TLHGCQPVTQEDGKESRI--SVQE--RQ | CD40 WT |
| 475 | KKVAKKPTNKAPHPKQEPQEINFPDDLPGSNTAA--TQEE--TLHGCQPVTQEDGKESRISVQERQ | CD40/v41BB |
| 476 | KKVAKKPTNKAPHPKQEPQEINFPDDLPGSNTAA--SKEE--TLHGCQPVTQEDGKESRISVQERQ | CD40/vTNFR2 |
| 477 | KKVAKKPTNKAPHPKQEPQEINFPDDLPGSNTAA--AVEE--TLHGCQPVTQEDGKESRISVQERQ | CD40/vATAR |
| 478 | KKVAKKPTNKAPHPKQEPQEINFPDDLPGSNTAAPVQE TLHGCQPVTQEDGKESRI--AVEE--RQ | CD40/vATAR |
| 479 | KKVAKKPTNKAPHPKQEPQEINFPDDLPGSNTAAPVQE TLHGCQPVTQEDGKESRI--PEEE--RQ | CD40/v41BB |

TABLE 3

Table 3 provides non-limiting examples of TRAF2/TRAF3 binding sequences.

Exemplary TRAF6 binding sequences

| | P-2 | P-1 | P0 | P1 | P2 | P3 | SEQ ID NO: |
|---|---|---|---|---|---|---|---|
| hCD40 | P | Q | E | I | N | F | 480 |
| hTRANCE-R | P | Q | E | I | D | F | 481 |
| Mal | P | P | E | L | R | F | 482 |
| TRIF | P | E | E | M | S | W | 483 |
| IRAK(1) | P | Q | E | N | S | Y | 484 |
| IRAK (2) | P | V | E | S | D | E | 485 |
| IRAK (3) | P | E | E | S | D | E | 486 |
| IRAK-2 (1) | P | E | E | T | D | E | 487 |
| IRAK-2 (2) | P | T | E | N | G | E | 488 |
| IRAK-M | P | V | E | D | D | E | 489 |
| RIP2 | P | P | E | N | Y | E | 490 |
| MyD88 | P | S | E | L | R | F | 491 |
| Consensus | P | X | E | X | X | Ac/Ar | 492 |

Ac = acidic residue;
Ar = Aromatic residue

Illustrative non-limiting examples of CD40 TRAF6 sequence variants include the following, the amino acids at P-2, P-1, P0, P1, P2, and P3 enclosed by dashes, and the TRAF6 sequence origin identified.

TABLE 4

Exemplary CD40 TRAF6 variants

| SEQ ID No: | Amino acid sequence based on CD40 | TRAF6 sequece origin |
|---|---|---|
| 493 | KKVAKKPTNKAPHPKQE--PQEINF--PDDLPGSNTAAPVQETLHGCQPVTQEDGKESRISVQERQ | CD40 WT |
| 494 | KKVAKKPTNKAPHPKQE--PEEMSW--PDDLPGSNTAAPVQETLHGCQPVTQEDGKESRISVQERQ | CD40/vTRIF |
| 495 | KKVAKKPTNKAPHPKQE--PPENYE--PDDLPGSNTAAPVQETLHGCQPVTQEDGKESRISVQERQ | CD40/VRIP2 |
| 496 | KKVAKKPTNKAPHPKQE--PQENSY--PDDLPGSNTAAPVQETLHGCQPVTQEDGKESRISVQERQ | CD40/vIRAK(1) |

TABLE 5

Exemplary CD40 TRAF2/TRAF3/TRAF6 consensus variants

| SEQ ID No: | Amino acid sequence variants based on CD40 |
|---|---|
| 497 | KKVAKKPTNKAPHPKQE--PQEINF--PDDLPGSNTAA--PVQE--TLHGCQPVTQEDGKESRI--SVQE--RQ |
| 498 | KKVAKKPTNKAPHPKQE--PXEXX(Ac/Ar)--PDDLPGSNTAAPVQETLHGCQPVTQEDGKESRISVQERQ |
| 499 | KKVAKKPTNKAPHPKQEPQEINFPDDLPGSNTAA--(P/S/A/T)X(Q/E)E--TLHGCQPVTQEDGKESRISVQERQ |
| 500 | KKVAKKPTNKAPHPKQEPQEINFPDDLPGSNTAAPVQETLHGCQPVTQEDGKESRI--(P/S/A/T)X(Q/E)E--RQ vided from the CD28 and CD40 signaling domains upon MSLN recognition by the binding domain can be sufficient to promote survival and proliferation of fusion protein expressing cells, the CD40 signaling domain can comprise SEQ ID NO: 521. In some embodiments, the CD40 signaling domain can comprise an SH3 motif, TRAF2 motif (SEQ ID NO:516, 517, or 518), TRAF6 motif (SEQ ID NO: 519), PKA (SEQ ID NO: 520 or 521), or a combination thereof, where the sequence list is shown in Table 7. In some embodiments, the CD40 domain is simply the amino acid structure shown in SEQ ID NO: 521, or one at least 60. 70. 80, 90, 95, 96, 97, 98, 99, or 100% identical thereto.

For reference, the human CD8 alpha chain protein sequence is set forth by GenBank accession No. NP_001139345.1, including signal peptide (amino acids 1-21), extracellular domain (amino acids 22-182), transmembrane domain (amino acids 183-203), and cytoplasmic domain (amino acids 204-235). The extracellular domain includes an immunoglobulin type domain (amino acids 28-128) which contains amino acids with compose the antigen binding site and amino acids that form the homodimer interface. The extracellular domain includes several asparagine residues which may be glycosylated, and the intracellular domain comprises serine and tyrosine residues, which may be phosphorylated.

For reference, the human IgG4 constant region sequence is set forth in UniProtKB/Swiss-Prot: accession No. P01861.1, including CH1 (amino acids 1-98), hinge (amino acids 99-110), CH2 (amino acids 111-220), CH3 (amino acids 221-327). The CH2 region includes asparagine at amino acid 177, which is the glycosylated and associated with Fc receptor and antibody-dependent cell-mediated cytotoxicity (ADCC).

For reference, the protein sequence of human CD137 (4-1BB), another TNFR superfamily member, is set forth by GenBank accession No. NP_001552.2, including signal peptide (amino acids 1-23), extracellular domain (amino acids 24-186), transmembrane domain (amino acids 187-213), and cytoplasmic domain (amino acids 214-255). Binding of CD137L ligand trimers expressed on antigen presenting cells to CD137 leads to receptor trimerization and activiation of signaling cascades involved in T cell reactivity and survival (Li et al., *Limited Cross-Linking of 4-1BB by 4-1BB Ligand and the Agonist Monoclonal Antibody Utomilumab*. Cell Reports 2018; 25:909-920). Coimmunoprecipitation of CD137 with the signaling adaptors TRAF-2 and TRAF-1 and the structural basis for the interactions has been reported (Ye, H et al., Molecular Cell, 1999; 4(3):321-30).

For reference, the human CD134 (OX40) protein sequence is set forth by GenBank accession No. NP_003318.1, including signal peptide (amino acids 1-28), extracellular domain (amino acids 29-214), transmembrane domain (amino acids 215-235), and cytoplasmic domain (amino acids 236-277). This receptor has been shown to activate NF-kappaB through its interaction with adaptor proteins TRAF2 and TRAF5 and studies suggest that this receptor promotes expression of apoptosis inhibitors BCL2 and BCL21L1/BCL2-XL.

The human T-cell surface antigen CD2 has at least two isoforms. For reference, the human CD2 isoform1 protein sequence is set forth by NP_001315538.1, including signal peptide (amino acids 1-24), extracellular domain (amino acids 25-235), transmembrane domain (amino acids 236-261), and cytoplasmic domain (amino acids 262-377). The human CD2 isoform2 protein sequence is set forth by NP_001758.2

For reference, the human CD357 (GITR) isoform-1 protein sequence is set forth by GenBank accession No. NP_004186.1, including signal peptide (amino acids 1-25), extracellular domain (amino acids 26-162), transmembrane domain (amino acids 163-183), and cytoplasmic domain (amino acids 184-241).

For reference, the human CD29 (beta1 integrin) protein sequence is set forth by GenBank accession No. NP_596867, including signal peptide (amino acids 1-20), extracellular domain (amino acids 21-728), transmembrane domain (amino acids 729-751), and cytoplasmic domain (amino acids 752-798).

The human CD150 (SLAM) protein sequence has at several isoforms. In addition to the transmembrane form of CD150 (mCD150), cells of hematopoietic lineage express mRNA encoding the secreted form of CD150 (sCD150), which lacks the entire transmembrane region of 30 amino acids. For reference, human SLAM isoform b is set forth by GenBank accession No. NP_003028.1, including signal peptide (amino acids 1-20), extracellular domain (amino acids 21-237), transmembrane domain (amino acids 238-258), and cytoplasmic domain (amino acids 259-335). Human SLAM isoform a is set forth by GenBank accession No. NP_001317683.1.

CD278 or ICOS (Inducible T cell COStimulator) is a CD28-superfamily costimulatory molecule that is expressed on activated T cells. Human ICOS precursor (199 aa with signal peptide) is set forth by GenBank accession No. NP_036224.1, including signal peptide (amino acids 1-20), an Ig-V-like domain (amino acids 21-140), transmembrane domain (amino acids 141-161) and intracellular domain (amino acids 162-199). ICOS contains an IProx motif sequence SSSVHDPNGE (SEQ ID NO:466). The IProx motif sequence SSSXXXPXGE (SEQ ID NO:467) resembles certain binding sites of TRAF1 (SASFQRPQSE (SEQ ID NO:468)), TRAF2 (SSSFQRPVND (SEQ ID NO:469)), TRAF3 (SSFKKPTGE (SEQ ID NO:470)), and TRAF5 (SSSFKRPDGE (SEQ ID NO:471)).

Hematopoietic cell signal transducer (HCST) also known as DAP10, KAP10, PIK3AP, and hematopoietic cell signal transducer (GenBank accession No. NP_055081.1) encodes a transmembrane signaling adaptor thought to form part of a receptor complex with the C-type lectin-like receptor NKG2D. The intracellular domain contains a YxxM motif of a phosphatidylinositol 3-kinase binding site.

In some embodiments the CoStAR targets carcinoembryonic antigen (CEA). In some embodiments, the CoStAR targets mesothelin (MSLN).

In some embodiments the CEA targeting CoStAR targets Carcinoembryonic antigen-related cell adhesion molecule 5 (CEACAM5) NCBI accession: NM_001291484.3. In some embodiments, the CEA scFv binds to CEACAM5.

In some embodiments, a CoStAR may be expressed alone under the control of a promoter in a therapeutic population of cells that have therapeutic activity, for example, Tumour Infiltrating Lymphocytes (TILs). Alternatively, the CoStAR may be expressed along with a therapeutic transgene such as a chimeric antigen receptor (CAR) and/or T-cell Receptor (TCR), (note that may lack up to about 5, for example 1, 2, 3, 4, 5, or up to 10 amino acids at the N-terminal of the mature receptor protein). Thus, some embodiments also relate to CoStAR constructs, not limited to those having a sequence as shown in any of SEQ ID NOS:42-185, 192-335, 344-430, including one of these sequences which lacks up to about 5, for example 1, 2, 3, 4, 5, or up to 10 amino acids at the N-terminal of the mature receptor protein). Suitable TCRs and CARs are well known in the literature, for example HLA-A*02-NYESO-1 specific TCRs (Rapoport et al. Nat Med 2015) or anti-CD19scFv.CD3ζ fusion CARs (Kochenderfer et al. J Clin Oncol 2015) which have been successfully used to treat Myeloma or B-cell malignancies respectively. The CoStARs described herein may be expressed with any known CAR or TCR thus providing the cell with a regulatable growth switch to allow cell expansion in-vitro or in-vivo, and a conventional activation mechanism in the form of the TCR or CAR for anti-cancer activity. Thus some embodiments provide a cell for use in adoptive cell therapy comprising a CoStAR as described herein and a TCR and/or CAR that specifically binds to a tumor associated antigen. An exemplary CoStAR comprising CD28 includes an extracellular antigen binding domain and an extracellular, transmembrane and intracellular signaling domain.

The term "antigen binding domain" as used herein refers to an antibody fragment including, but not limited to, a diabody, a Fab, a Fab', a F(ab')2, an Fv fragment, a disulfide stabilized Fv fragment (dsFv), a (dsFv)2, a bispecific dsFv (dsFv-dsFv'), a disulfide stabilized diabody (ds diabody), a single-chain antibody molecule (scFv), an scFv dimer (bivalent diabody), a multispecific antibody formed from a portion of an antibody comprising one or more CDRs, a camelized single domain antibody, a nanobody, a domain antibody, a bivalent domain antibody, or any other antibody fragment that binds to an antigen but does not comprise a complete antibody structure. An antigen binding domain is capable of binding to the same antigen to which the parent antibody or a parent antibody fragment (e.g., a parent scFv) binds. In some embodiments, an antigen-binding fragment may comprise one or more complementarity determining regions (CDRs) from a particular human antibody grafted to frameworks (FRs) from one or more different human antibodies. An "antigen binding domain" may be referred to as a "ligand binding domain."

In some embodiments, the scFV comprises a VH and/or VL with at 70% identity to the polypeptides in SEQ ID NOs: 12. In some embodiments, the scFV comprises a VH and/or VL with at 75% identity to the polypeptides in SEQ ID NOs: 12. In some embodiments, the scFV comprises a VH and/or VL with at 80% identity to the polypeptides in SEQ ID NOs: 12. In some embodiments, the scFV comprises a VH and/or VL with at 85% identity to the polypeptides in SEQ ID NOs: 12. In some embodiments, the scFV comprises a VH and/or VL with at 90% identity to the polypeptides in SEQ ID NOs: 12. In some embodiments, the CDRs of SEQ ID NOs: 12 have 1 point mutation. In some embodiments, the CDRs of SEQ ID NOs: 12 have 2 point mutations. In some embodiments, the CDRs of SEQ ID NOs: 12 have 3, 4 or 5 point mutations. In some embodiments, the sequence(s) are those shown in FIG. 83. In some embodiments, the binding domain is defined by the amino acid structure alone, and can be any one of those sequences provided herein regarding such amino acid structures. It shall be appreciated that all embodiments disclosed herein regarding CEA also apply for the corresponding arrangements in Table 7.

In some embodiments, any of the structural arrangements in FIG. 28 can be used with any of the sequences in Table 7, or any of the other tables herein, and/or any of the noted sequences or related sequences in the figures. In some embodiments, any of HDR1, HCDR2, HCDR3, LCDR1, LCDR2, LCDR3, VH, VL, and/or the scFV disclosed in Table 7, or any of the other tables herein, and/or any of the noted sequences and/or related sequences in the figures can be used in one or more of the arrangements in FIG. 28. In some embodiments, any of the scFv sequences, especially the CEA scFv identified sequences can be used in this manner. In some embodiments, any of the above sequences, or any sequences that are at least 70, 75, 80, 85, 90, 95, 96, 97, 98, 99, or 100% identical or similar thereto can be used in FIG. 28. In some embodiment, the CoStAR can have components that are functionally characterized or characterizable as provided herein. In some embodiment, the fusion protein can have components that are purely structurally defined (such as by amino acid or nucleic acid sequence) as provided herein. In some embodiments, a fusion protein is provided that includes an amino acid sequence that is at least 70, 75, 80, 85, 90, 95, 96, 97, 98, 99, or 100% identical or similar to SEQ ID NO: 348. In some embodiments, any one or more of the sequences in FIG. 83 can be used in an arrangement FIG. 28, including any sequence that is at least 70, 75, 80, 85, 90, 95, 96, 97, 98, 99, or 100% identical or similar to any one or more the sequences.

In some embodiments, the scFV comprises a VH and/or VL with at 70% identity to the polypeptides in any one of SEQ ID NOs: 186-191. In some embodiments, the scFV comprises a VH and/or VL with at 75% identity to the polypeptides in any one of SEQ ID NOs: 186-191. In some embodiments, the scFV comprises a VH and/or VL with at 80% identity to the polypeptides in any one of SEQ ID NOs: 186-191. In some embodiments, the scFV comprises a VH and/or VL with at 85% identity to the polypeptides in any one of SEQ ID NOs: 186-191. In some embodiments, the scFV comprises a VH and/or VL with at 90% identity to the polypeptides in any one of SEQ ID NOs: 186-191. In some embodiments, the CDRs of any one of SEQ ID NOs: 186-191 have 1 point mutation. In some embodiments, the CDRs of any one of SEQ ID NOs: 186-191 have 2 point mutations. In some embodiments, the CDRs of any one of SEQ ID NOs: 186-191 have 3, 4 or 5 point mutations. In some embodiments, the sequence(s) are those shown in FIG. 84. In some embodiments, the binding domain is defined by the amino acid structure alone, and can be any one of those sequences provided herein regarding such amino acid structures. It shall be appreciated that all embodiments disclosed herein regarding MSLN also apply for the corresponding arrangements in Table 7.

In some embodiments, any of the structural arrangements in any one or more of FIGS. 62, 63A, 64, 65, 66, 67, 69B, 70A, 70B, and 84A can be used with any of the sequences in Table 7, or any of the other tables herein, and/or any of the noted sequences or related sequences in the figures. In some embodiments, any of HDR1, HCDR2, HCDR3, LCDR1, LCDR2, LCDR3, VH, VL, and/or the scFV disclosed in Table 7, or any of the other tables herein, and/or any of the noted sequences and/or related sequences in the figures can be used in one or more of the arrangements in any one or more of FIGS. 62, 63A, 64, 65, 66, 67, 69B, 70A, 70B, and 84A. In some embodiments, any of the scFv sequences, especially the CEA scFv identified sequences can be used in this manner. In some embodiments, any of the above sequences, or any sequences that are at least 70, 75, 80, 85, 90, 95, 96, 97, 98, 99, or 100% identical or similar thereto can be used in any one or more of FIGS. 62, 63A, 64, 65, 66, 67, 69B, 70B, and 84A. In some embodiment, the CoStAR can have components that are functionally characterized or characterizable as provided herein. In some embodiment, the fusion protein can have components that are purely structurally defined (such as by amino acid or nucleic acid sequence) as provided herein. In some embodiments, a fusion protein is provided that includes an amino acid sequence that is at least 70, 75, 80, 85, 90, 95, 96, 97, 98, 99, or 100% identical or similar to any one or more of SEQ ID NOs: 192, 210, 228, 246, 264, and/or 282. In some embodiments, any one or more of the sequences in FIGS. 84A-84C can be used in an arrangement of any one or more of FIGS. 62, 63A,64, 65, 66, 67, 69B, 70B, and 84A, including any sequence that is at least 70, 75, 80, 85, 90, 95, 96, 97, 98, 99, or 100% identical or similar to any one or more the sequences.

The antigen binding domain can be made specific for any disease-associated antigen, including but not limited to tumor-associated antigens (TAAs) and infectious disease-associated antigens. In some embodiments, the ligand binding domain is bispecific. Antigens have been identified in most of the human cancers, including Burkitt lymphoma, neuroblastoma, melanoma, osteosarcoma, renal cell carcinoma, breast cancer, prostate cancer, lung carcinoma, and colon cancer. TAA's include, without limitation, CD19, CD20, CD22, CD24, CD33, CD38, CD123, CD228, CD138, BCMA, GPC3, CEA, folate receptor (FRα), mesothelin, CD276, gp100, 5T4, GD2, EGFR, MUC-1, PSMA, EpCAM, MCSP, SM5-1, MICA, MICB, ULBP and HER-2. TAAs further include neoantigens, peptide/MHC complexes, and HSP/peptide complexes.

In some embodiments, the antigen binding domain comprises a T-cell receptor or binding fragment thereof that binds to a defined tumor specific peptide-MHC complex. The term "T cell receptor," or "TCR," refers to a heterodimeric receptor composed of αβ or γδ chains that pair on the surface of a T cell. Each α, β, γ, and δ chain is composed of two Ig-like domains: a variable domain (V) that confers antigen recognition through the complementarity determining regions (CDR), followed by a constant domain (C) that is anchored to cell membrane by a connecting peptide and a transmembrane (TM) region. The TM region associates with the invariant subunits of the CD3 signaling apparatus. Each of the V domains has three CDRs. These CDRs interact with a complex between an antigenic peptide bound to a protein encoded by the major histocompatibility complex (pMHC) (Davis and Bjorkman (1988) Nature, 334, 395-402; Davis et al. (1998) Annu Rev Immunol, 16, 523-544; Murphy (2012), xix, 868 p.).

In some embodiments, the antigen binding domain comprises a natural ligand of a tumor expressed protein or tumor-binding fragment thereof. A non-limiting example is PD1 which binds to PDL1. Another example is the transferrin receptor 1 (TfR1), also known as CD71, a homodimeric protein that is a key regulator of cellular iron homeostasis and proliferation. Although TfR1 is expressed at a low level in a broad variety of cells, it is expressed at higher levels in rapidly proliferating cells, including malignant cells in which overexpression has been associated with poor prognosis. In some embodiments, the antigen binding domain comprises transferrin or a transferrin receptor-binding fragment thereof.

In some embodiments, the antigen binding domain is specific to a defined tumor associated antigen, such as but not limited to FRα, CEA, 5T4, CA125, SM5-1 or CD71. In some embodiments, the tumor associated antigen can be a tumor-specific peptide-MHC complex. In certain such embodiments, the peptide is a neoantigen. In other embodiments, the tumor associated antigen it a peptide-heat shock protein complex.

In some embodiments, the binding domain allows targeting of the cancer treatment specifically to CEA or MSLN expressing cancer cells. In some embodiments, the binding domain can comprise an scFv, a peptide, an antibody heavy-chain, a natural ligand, or a receptor specific for CEA or MSLN. In some embodiments, the binding domain can comprise a polypeptide comprising an scFv with the sequence comprising any one of SEQ ID NO: 186-191, where the sequence is shown in FIG. 84. In some embodiments, the binding domain can be linked to the transmembrane domain by a linker and/or a spacer. In some embodiments, the binding domain is that in SEQ ID NO: 185-191. In some embodiments, the binding domain is at least 70, 80, 90, 95, 96, 97, 98, 99 or 100% identical to that in SEQ ID NO: 186-191 (or any of the corresponding sequences for a different target in FIG. 84). In some embodiments, the binding domain comprises a VH and/or VL that is at least 70, 80, 90, 95, 96, 97, 98, 99 or 100% identical to the VH, and/or VL in SEQ ID NOs: 12 (or any of the corresponding sequences for a different target in FIG. 83, such as for MSLN or CEA). In some embodiments, the binding domain comprises a HCDR1, HCDR2, HCDR3, LCDR1, LCDR2, and/or LCDR3 that is at least 70, 80, 90, or 100% identical to the HCDR1, HCDR2, HCDR3, LCDR1, LCDR2, and/or LCDR3 in SEQ ID NOs: 186-191 and 12 (or any of the corresponding sequences for a different target in FIG. 83 or 84).

In some embodiments, a CoStAR comprises:

i. an scFv that binds to carcinoembryonic antigen (CEA) or mesothelin (MSLN), a spacer and transmembrane sequence of CD28, an ICOS domain or a CD28 signaling domain, and a CD40 signaling domain.

ii. an scFv that binds to CEA or MSLN, a spacer and transmembrane sequence of CD28, and a CD40 signaling domain.

iii. an scFv that binds to CEA or MSLN, a spacer and transmembrane sequence of CD28, a CD137 signaling domain, and a CD40 signaling domain.

iv. an scFv that binds to CEA or MSLN, a spacer and transmembrane sequence of CD28, a CD134 signaling domain, and a CD40 signaling domain.

v. an scFv that binds to CEA or MSLN, a spacer and transmembrane sequence of CD28, a CD2 signaling domain, and a CD40 signaling domain.

vi. an scFv that binds to CEA or MSLN, a spacer and transmembrane sequence of CD28, a GITR signaling domain, and a CD40 signaling domain.

vii. an scFv that binds to CEA or MSLN, a spacer and transmembrane sequence of CD28, a CD29 signaling domain, and a CD40 signaling domain.

viii. an scFv that binds to CEA or MSLN, a spacer and transmembrane sequence of CD28, a CD150 signaling domain, and a CD40 signaling domain.

ix. an scFv that binds to CEA or MSLN, a spacer and transmembrane sequence of CD8, a CD28 signaling domain, and a CD40 signaling domain.

x. an scFv that binds to CEA or MSLN, a spacer and transmembrane sequence of CD8, and a CD40 signaling domain.

xi. an scFv that binds to CEA or MSLN, a spacer and transmembrane sequence of CD8, a CD137 signaling domain, and a CD40 signaling domain.

xii. an scFv that binds to CEA or MSLN, a spacer and transmembrane sequence of CD8, a CD134 signaling domain, and a CD40 signaling domain.

xiii. an scFv that binds to CEA or MSLN, a spacer and transmembrane sequence of CD8, a CD2 signaling domain, and a CD40 signaling domain.

xiv. an scFv that binds to CEA or MSLN, a spacer and transmembrane sequence of CD8, a GITR signaling domain, and a CD40 signaling domain.

xv. an scFv that binds to CEA or MSLN, a spacer and transmembrane sequence of CD8, a CD29 signaling domain, and a CD40 signaling domain.

xvi. an scFv that binds to CEA or MSLN, a spacer and transmembrane sequence of CD8, a CD150 signaling domain, and a CD40 signaling domain.

xvii. an scFv that binds to CEA or MSLN, a spacer comprising an IgG4 constant region and CD28 transmembrane sequence, a CD28 signaling domain, and a CD40 signaling domain.

xviii. an scFv that binds to CEA or MSLN, a spacer comprising an IgG4 constant region and CD28 transmembrane sequence, and a CD40 signaling domain.

xix. an scFv that binds to CEA or MSLN, a spacer comprising an IgG4 constant region and CD28 transmembrane sequence, a CD137 signaling domain, and a CD40 signaling domain.

xx. an scFv that binds to CEA or MSLN, a spacer comprising an IgG4 constant region and CD28 transmembrane sequence, a CD134 signaling domain, and a CD40 signaling domain.

xxi. an scFv that binds to CEA or MSLN, a spacer comprising an IgG4 constant region and CD28 transmembrane sequence, a CD2 signaling domain, and a CD40 signaling domain.

xxii. an scFv that binds to CEA or MSLN, a spacer comprising an IgG4 constant region and CD28 transmembrane sequence, a GITR signaling domain, and a CD40 signaling domain.

xxiii. an scFv that binds to CEA or MSLN, a spacer comprising an IgG4 constant region and CD28 transmembrane sequence, a CD29 signaling domain, and a CD40 signaling domain.

xxiv. an scFv that binds to CEA or MSLN, a spacer comprising an IgG4 constant region and CD28 transmembrane sequence, a CD150 signaling domain, and a CD40 signaling domain.

xxv. an scFv that binds to CEA or MSLN, a spacer comprising an IgG4 constant region and CD28 transmembrane sequence, a first CD40 signaling domain and a second CD40 signaling domain xxvi. an scFv that binds to CEA or MSLN, a spacer comprising an IgG4 constant region and CD28 transmembrane sequence, a first CD40 signaling domain and a second mutated CD40 signaling domain xxvii. an scFv that binds to CEA or MSLN, a binding domain that binds to PDL1, a short spacer and transmembrane sequence of CD28, a CD28 signaling domain, and a CD40 signaling domain.

xxviii. an scFv that binds to CEA or MSLN, a binding domain that binds to PDL1, a short spacer and transmembrane sequence of CD28, and a CD40 signaling domain.

xxix. an scFv that binds to CEA or MSLN, a binding domain that binds to CD155, CD112, or CD113, a CD28 transmembrane domain, a CD28 signaling domain, and a CD40 signaling domain.

xxx. a binding domain that binds to CD155, CD112, or CD113, a CD28 transmembrane domain, and a CD40 signaling domain.

xxxi. an scFv that binds to CEA or MSLN, a binding domain that binds to PDL1, a short spacer and transmembrane sequence of CD28, a CD28 signaling domain, and a CD40 signaling domain.

xxxii. an scFv that binds to CEA or MSLN, a binding domain that binds to PDL1, a short spacer and transmembrane sequence of CD28, and a CD40 signaling domain.

xxxiii. an scFv that binds to CEA or MSLN, a binding domain that binds to CD155, CD112, or CD113, a short spacer and transmembrane sequence of CD28, a CD28 signaling domain, and a CD40 signaling domain.

xxxiv. an scFv that binds to CEA or MSLN, a binding domain that binds to CD155, CD112, or CD113, a short spacer and transmembrane sequence of CD28, and a CD40 signaling domain.

xxxv. an scFv that binds to CEA or MSLN, a spacer comprising the CD28 extracellular domain, and transmembrane sequence of CD28, and a NTRK1 signaling domain xxxvi. an scFv that binds to CEA or MSLN, a spacer comprising the CD28 extracellular domain and transmembrane sequence of CD28, a NTRK1 signaling domain, and a CD40 signaling domain.

xxxvii. an scFv that binds to CEA or MSLN, a spacer comprising the CD28 extracellular domain and transmembrane sequence of CD28, a CD28 signaling domain, and a NTRK1 signaling domain.

xxxviii. an scFv that binds to CEA or MSLN, a spacer comprising the CD28 extracellular domain and transmembrane sequence of CD28, a CD28 signaling domain, a NTRK1 signaling domain, and a CD40 signaling domain.

xxxix. an scFv that binds to CEA or MSLN, a spacer comprising the ICOS extracellular domain and transmembrane sequence of ICOS, an ICOS signaling domain, and a CD40 signaling domain xl. an scFv that binds to CEA or MSLN, a spacer comprising the CD28 extracellular domain and transmembrane sequence of CD28, a CD28 signaling domain, and an ICOS signaling domain.

xli. an scFv that binds to CEA or MSLN, a spacer comprising the CD28 extracellular domain and transmembrane sequence of CD28, a CD28 signaling domain, an ICOS signaling domain, and a CD40 signaling domain.

xlii. an scFv that binds to CEA or MSLN, a spacer comprising the CD2 extracellular domain and transmembrane sequence of CD2, a CD2 signaling domain, and a CD40 signaling domain.

xliii. an scFv that binds to CEA or MSLN, a spacer comprising the CD28 extracellular domain and transmembrane sequence of CD28, a CD28 signaling domain, and a CD2 signaling domain.

xliv. an scFv that binds to CEA or MSLN, a spacer comprising the CD28 extracellular domain and transmembrane sequence of CD28, a CD28 signaling domain, a CD40 signaling domain, and a CD2 signaling domain.

xlv. an scFv that binds to CEA or MSLN, a spacer comprising the CD28 extracellular domain and transmembrane sequence of CD28, a CD28 signaling domain, and aCD137 signaling domain.

xlvi. an scFv that binds to CEA or MSLN, a spacer comprising the CD28 extracellular domain and transmembrane sequence of CD28, a CD28 signaling domain, a CD40 signaling domains, and a CD137 signaling domain.

xlvii. an scFv that binds to CEA or MSLN, a spacer comprising the CD28 extracellular domain and transmembrane sequence of CD28, a CD28 signaling domain, and a DAP10 signaling domain.

xlviii. an scFv that binds to CEA or MSLN, a spacer comprising the CD28 extracellular domain and transmembrane sequence of CD28, a CD28 signaling domain, a CD40 signaling domain, and a DAP10 signaling domain.

xlix. an scFv that binds to CEA or MSLN, a spacer comprising the CD28 extracellular domain and transmembrane sequence of CD28, a CD28 signaling domain, and a CD134 signaling domain.

xix. an scFv that binds to CEA or MSLN, a spacer comprising the CD28 extracellular domain and transmembrane sequence of CD28, a CD40 signaling domain, and a CD134 signaling domain.

In some embodiments, a CoStAR comprises an scFv that binds to MSLN linked to the spacer, transmembrane, and signaling domain structure of any one of paragraphs i-xlx.

In some embodiments, a CoStAR comprises an scFv that binds to FolR1linked to the spacer, transmembrane, and signaling domain structure of any one of paragraphs i-xlx.

In some embodiments, a CoStAR comprises the spacer, transmembrane, and signaling domain structure of any one of i-xxxiv and binds to FolR1 or MSLN by a binding domain which comprises an antigen-binding fragment of scFv MOV19 (SEQ ID NO:9).

In some embodiments, a CoStAR comprises the spacer, transmembrane, and signaling domain structure of any one of i-xxxiv and binds to CEA by a binding domain which comprises an antigen-binding fragment of scFv MFE23 (SEQ ID NO: 10).

In some embodiments, a CoStAR comprises the spacer, transmembrane, and signaling domain structure of any one of i-xxvi and xxxi to xxxiv and binds to CEA by a binding domain which comprises an antigen-binding fragment of scFv MFE23(K>Q) (SEQ ID NO:11).

In some embodiments, a CoStAR comprises the spacer, transmembrane, and signaling domain structure of any one of i-xxvi and xxxi to xxxiv and binds to CEA by a binding domain which comprises an antigen-binding fragment of humanized scFv MFE23 (hMFE23) (SEQ ID NO:12).

In some embodiments, a CoStAR comprises the spacer, transmembrane, and signaling domain structure of any one of i-xxvi and xxxi to xxxiv and binds to CEA by a binding domain which comprises an antigen-binding fragment of scFv CEA6 (SEQ ID NO:13).

In some embodiments, a CoStAR comprises the spacer, transmembrane, and signaling domain structure of any one of i-xxvi and xxxi to xxxiv and binds to CEA by a binding domain which comprises an antigen-binding fragment of scFv BW431/26 (SEQ ID NO:14).

In some embodiments, a CoStAR comprises the spacer, transmembrane, and signaling domain structure of any one of i-xxvi and xxxi to xxxiv and binds to CEA by a binding domain which comprises an antigen-binding fragment of scFv HuT84.66(M5A) (SEQ ID NO:15).

In some embodiments, a CoStAR comprises the spacer, transmembrane, and signaling domain structure of any one of i-xxxiv and binds to FolR1 by a binding domain which comprises an antigen-binding fragment of scFv MOV19 (SEQ ID NO:9).

In some embodiments, a CoStAR comprises the spacer, transmembrane, and signaling domain structure of any one of i-xxxiv and xxxi to xxxiv and binds to MSLN by a binding domain which comprises an antigen-binding fragment of scFv SS1 (SEQ ID NO:186).

In some embodiments, a CoStAR comprises the spacer, transmembrane, and signaling domain structure of any one of i-xxvi and xxxi to xxxiv and binds to MSLN by a binding domain which comprises an antigen-binding fragment of scFv M5 (humanized SS1) (SEQ ID NO:187).

In some embodiments, a CoStAR comprises the spacer, transmembrane, and signaling domain structure of any one of i-xxvi and xxxi to xxxiv and binds to MSLN by a binding domain which comprises an antigen-binding fragment of humanized scFv HN1 (SEQ ID NO:188).

In some embodiments, a CoStAR comprises the spacer, transmembrane, and signaling domain structure of any one of i-xxvi and xxxi to xxxiv and binds to MSLN by a binding domain which comprises an antigen-binding fragment of scFv M912 (SEQ ID NO:189 or SEQ ID NO:511).

In some embodiments, a CoStAR comprises the spacer, transmembrane, and signaling domain structure of any one of i-xxvi and xxxi to xxxiv and binds to MSLN by a binding domain which comprises an antigen-binding fragment of scFv HuYP218 (SEQ ID NO:190 or SEQ ID NO: 512).

In some embodiments, a CoStAR comprises the spacer, transmembrane, and signaling domain structure of any one of i-xxvi and xxxi to xxxiv and binds to MSLN by a binding domain which comprises an antigen-binding fragment of scFv P4 (SEQ ID NO:191 or SEQ ID NO: 513).

As use herein, the term "specifically binds" or "is specific for" refers to measurable and reproducible interactions, such as binding between a target and an antibody or antibody moiety that is determinative of the presence of the target in the presence of a heterogeneous population of molecules, including biological molecules. For example, an antibody moiety that specifically binds to a target (which can be an epitope) is an antibody moiety that binds the target with greater affinity, avidity, more readily, and/or with greater duration than its bindings to other targets. In some embodiments, an antibody moiety that specifically binds to an antigen reacts with one or more antigenic determinants of the antigen (for example a cell surface antigen or a peptide/MHC protein complex) with a binding affinity that is at least about 10 times its binding affinity for other targets. In some embodiments, specifically binds denotes an affinity of at least $10^6$, $10^7$, $10^8$, $10^9$, or $10^{10}$ $M^{-1}$. Specific binding is detectably higher in magnitude and distinguishable from non-specific binding occurring to at least one unrelated target. Specific binding can be the result of formation of bonds between particular functional groups or particular spatial fit (e.g., lock and key type) whereas nonspecific binding is usually the result of van der Waals forces. Specific binding does not however necessarily imply that an antibody or fusion protein binds one and only one target.

A full length antibody structural unit is a tetramer of subunits. Each tetramer includes two identical pairs of polypeptide chains, each pair having one "light" (about 25 kDa) and one "heavy" chain (about 50-70 kDa). The amino-terminal portion of each chain includes a variable region of about 100 to 110 or more amino acids primarily responsible for antigen recognition. This variable region is initially expressed linked to a cleavable signal peptide. The variable region without the signal peptide is sometimes referred to as a mature variable region. Thus, for example, a light chain mature variable region means a light chain variable region without the light chain signal peptide. However, reference to a variable region does not mean that a signal sequence is necessarily present; and in fact signal sequences are cleaved once the antibodies or fusion proteins have been expressed and secreted. A pair of heavy and light chain variable regions defines a binding region of an antibody. The carboxyterminal portion of the light and heavy chains respectively defines light and heavy chain constant regions.

Light chains are classified as either kappa or lambda. Heavy chains are classified as gamma, mu, alpha, delta, or epsilon, and define the antibody's isotype as IgG, IgM, IgA, IgD and IgE, respectively. Within light and heavy chains, the variable and constant regions are joined by a "J" segment of about 12 or more amino acids, with the heavy chain also including a "D" segment of about 10 or more amino acids. (See generally, Fundamental Immunology (Paul, W., ed., 2nd ed. Raven Press, N.Y., 1989), Ch. 7) (incorporated by reference in its entirety for all purposes).

The mature variable regions of each light/heavy chain pair form the antibody binding site. Thus, an intact antibody has two binding sites, i.e., is divalent. In natural antibodies, the binding sites are the same. However, bispecific antibodies can be made in which the two binding sites are different (see, e.g., Songsivilai S, Lachmann P C. 1990. Bispecific antibody: a tool for diagnosis and treatment of disease. Clin Exp Immunol. 79:315-321; Kostelny S A, Cole M S, Tso J Y. 1992. Formation of bispecific antibody by the use of leucine zippers. J Immunol. 148: 1547-1553). The variable regions all exhibit the same general structure of relatively conserved framework regions (FR) joined by three hypervariable regions, also called complementarity determining regions or CDRs. The CDRs from the two chains of each pair are aligned by the framework regions, enabling binding to a specific epitope. From N-terminal to C-terminal, both light and heavy chains comprise the domains FR1, CDR1, FR2, CDR2, FR3, CDR3 and FR4. For convenience, the variable heavy CDRs can be referred to as HCDR1, HCDR2 and HCDR3; the variable light chain CDRs can be referred to as LCDR1, LCDR2 and LCDR3. The assignment of amino acids to each domain is in accordance with the definitions of Kabat E A, et al. 1987 and 1991. Sequences of Proteins of Immunological Interest (National Institutes of Health, Bethesda, Md.) or Chothia C, Lesk A M. 1987. Canonical Structures for the Hypervariable Regions of Immunoglobulins. J Mol Biol 196:901-917; Chothia C, et al. 1989. Conformations of Immunoglobulin Hypervariable Regions. Nature 342:877-883. Kabat also provides a widely used numbering convention (Kabat numbering) in which corresponding residues between different heavy chain variable regions or between different light chain variable regions are assigned the same number. Although Kabat numbering can be used for antibody constant regions, EU numbering can also be used.

The term "epitope" refers to a site on an antigen to which an antibody binds. An epitope on a protein can be formed from contiguous amino acids or noncontiguous amino acids juxtaposed by tertiary folding of one or more proteins.

As noted herein, the binding of the CoStAR is achieved via a binding domain, which can include an antibody or binding fragment thereof. Examples of binding fragments include Fv, Fab', Fab'-SH, F(ab')2; diabodies; linear antibodies; single-chain antibody molecules (e.g. scFv); and multispecific antibodies formed from antibody fragments. scFv antibodies are described in Houston J S. 1991. Methods in Enzymol. 203:46-96. In addition, antibody fragments comprise single chain polypeptides having the characteristics of a VH domain, namely being able to assemble together with a VL domain, or of a VL domain, namely being able to assemble together with a VH domain to a functional antigen binding site and thereby providing the antigen binding property of full length antibodies.

Spacer

In some embodiments, a CoStAR optionally comprises a spacer region between the antigen binding domain and the costimulatory receptor. As used herein, the term "spacer" refers to the extracellular structural region of a CoStAR that separates the antigen binding domain from the external ligand binding domain of the costimulatory protein. The spacer provides flexibility to access the targeted antigen and receptor ligand. In some embodiments long spacers are employed, for example to target membrane-proximal epitopes or glycosylated antigens (see Guest R. D. et al. The role of extracellular spacer regions in the optimal design of chimeric immune receptors: evaluation of four different scFvs and antigens. J. Immunother. 2005; 28:203-211; Wilkie S. et al., Retargeting of human T cells to tumor-associated MUC 1: the evolution of a chimeric antigen receptor. J. Immunol. 2008; 180:4901-4909). In other embodiments, CoStARs bear short spacers, for example to target membrane distal epitopes (see Hudecek M. et al., Receptor affinity and extracellular domain modifications affect tumor recognition by ROR1-specific chimeric antigen receptor T cells. Clin. Cancer Res. 2013; 19:3153-3164; Hudecek M. et al., The nonsignalling extracellular spacer domain of chimeric antigen receptors is decisive for in vivo antitumor activity. Cancer Immunol. Res. 2015; 3:125-135). In some embodiments, the spacer comprises all or part of or is derived from an IgG hinge, including but not limited to IgG1, IgG2, or IgG4. By "derived from an Ig hinge" is meant a spacer comprising insertions, deletions, or mutations in an IgG hinge. In some embodiments, a spacer can comprise all or part of one or more antibody constant domains, such as but not limited to CH2 and/or CH3 domains. In some embodiments, in a spacer comprising all or part of a CH2 domain, the CH2 domain is modified so as not to bind to an Fc receptor. For example, Fc receptor binding in myeloid cells has been found to impair CAR T cell functionality. In some embodiments, the spacer comprises all or part of an Ig-like hinge from CD28, CD8, or other protein comprising a hinge region. In some embodiments, the CoStAR comprises a spacer, the spacer is from 1 and 50 amino acids in length.

In an non-limiting embodiment, the spacer comprises essentially all of an extracellular domain, for example a CD28 extracellular domain (i.e. from about amino acid 19, 20, 21, or 22 to about amino acid 152) or an extracellular domain of another protein, including but not limited to another TNFR superfamily member. In an embodiment, the spacer comprises a portion of an extracellular domain, for example a portion of a CD28 extracellular domain, and may lack all or most of the Ig domain. In another embodiment, the spacer includes amino acids of CD28 from about 141 to about 152 but not other portions of the CD28 extracellular domain. In another embodiment, the spacer includes amino acids of CD8 from about 128 to about 182 but not other portions of the CD8 extracellular domain.

In some embodiments, the spacer in an anti-MSLN CoStAR is a CD28 spacer domain, truncated CD28 spacer domain, or CD8 spacer domain. In some embodiments, changing the spacer domain can result in increased secretion of T cell effector cytokines upon recognition of signal 1 and signal 2. In some embodiments the T cell effector cytokines are IL-2, IFNγ, and TNFα.

Linker

In some embodiments, the CoStAR extracellular domain comprises a linker. Linkers comprise short runs of amino acids used to connect domains, for example a binding domain with a spacer or transmembrane domain. In order for there to be flexibility to bind ligand, a ligand binding domain will usually be connected to a spacer or a transmembrane domain by flexible linker comprising from about 5 to 25 amino acids, such as, for example, AAAGSGGSG (SEQ ID NO:18), GGGGSGGGGSGGGGS (SEQ ID NO:431). In some embodiments, a CoStAR comprises a binding domain joined directly to a transmembrane domain by a linker, and without a spacer. In some embodiments, a CoStAR comprises a binding domain joined directly to a transmembrane by a spacer and without a linker.

Signaling Domain

As discussed above, in some embodiments, a CoStAR comprises a full length primary costimulatory receptor which can comprise an extracellular ligand binding and intracellular signaling portion of, without limitation, CD2, CD9, CD26, CD27, CD28, CD29, CD38, CD40, CD43, CD46, CD49d, CD55, CD73, CD81, CD82, CD99, CD100, CD134 (OX40), CD137 (41BB), CD150 (SLAM), CD270 (HVEM), CD278 (ICOS), CD357 (GITR), or EphB6. In other embodiments, the costimulatory receptor comprises a chimeric protein, for instance comprising an extracellular ligand binding domain of one of the aforementioned proteins and an intracellular signaling domain of another of the aforementioned proteins. In some embodiments, the signaling portion of the CoStAR comprises a single signaling domain. In other embodiments, the signaling portion of the CoStAR comprises a second intracellular signaling domain such as but not limited to: CD2, CD27, CD28, CD40, CD134 (OX40), CD137 (4-1BB), CD150 (SLAM). In some embodiments, the first and second intracellular signaling domains are the same. In other embodiments, the first and second intracellular signaling domains are different. In some embodiments, the costimulatory receptor is capable of dimerization. Without being bound by theory, it is thought that CoStARs dimerize or associate with other accessory molecules for signal initiation. In some embodiments, CoStARs dimerize or associate with accessory molecules through transmembrane domain interactions. In some embodiments, dimerization or association with accessory molecules is assisted by costimulatory receptor interactions in the intracellular portion, and/or the extracellular portion of the costimulatory receptor.

Transmembrane Domain

Although the main function of the transmembrane is to anchor the CoStAR in the T cell membrane, in some embodiments, the transmembrane domain influences CoStAR function. In some embodiments, the transmembrane domain is comprised by the full length primary costimulatory receptor domain. In embodiments, the CoStAR construct comprises an extracellular domain of one receptor and an intracellular signaling domain of a second receptor, the transmembrane domain can be that of the extracellular domain or the intracellular domain. In some embodiments, the transmembrane domain is from CD4, CD8α, CD28, or ICOS. Gueden et al. associated use of the ICOS transmembrane domain with increased CAR T cell persistence and overall anti-tumor efficacy (Guedan S. et al., Enhancing CAR T cell persistence through ICOS and 4-1BB costimulation. JCI Insight. 2018; 3:96976). In an embodiment, the transmembrane domain comprises a hydrophobic α helix that spans the cell membrane.

In an embodiment, the transmembrane domain comprises amino acids of the CD28 transmembrane domain from about amino acid 153 to about amino acid 179. In another embodiment, the transmembrane domain comprises amino acids of the CD8 transmembrane domain from about amino acid 183 to about amino acid 203. In some embodiments, the CoStARs may include several amino acids between the transmembrane domain and signaling domain. For example, in one construct described herein the link from a CD8 transmembrane domain to a signaling domain comprises several amino acids of the CD8 cytoplasmic domain (e.g., amino acids 204-210 of CD8).

Variants

In some embodiments, amino acid sequence variants of the antibody moieties or other moieties provided herein are contemplated. For example, it may be desirable to improve the binding affinity and/or other biological properties of the antibody moiety. Amino acid sequence variants of an antibody moiety may be prepared by introducing appropriate modifications into the nucleotide sequence encoding the antibody moiety, or by peptide synthesis. Such modifications include, for example, deletions from, and/or insertions into and/or substitutions of residues within the amino acid sequences of the antibody moiety. Any combination of deletion, insertion, and substitution can be made to arrive at the final construct, provided that the final construct possesses the desired characteristics, e.g., antigen-binding.

In some embodiments, antibody binding domain moieties comprising one or more amino acid substitutions, deletions, or insertions are provided. Sites of interest for mutational changes include the antibody binding domain heavy and light chain variable regions (VRs) and frameworks (FRs). Amino acid substitutions may be introduced into a binding domain of interest and the products screened for a desired activity, e.g., retained/improved antigen binding or decreased immunogenicity. In some embodiments, amino acid substitutions may be introduced into one or more of the primary co-stimulatory receptor domain (extracellular or intracellular), secondary costimulatory receptor domain, or extracellular co-receptor domain. Accordingly, some embodiments encompass CoStAR and/or fusion proteins and component parts particularly disclosed herein as well as variants thereof, i.e. CoStAR and/or fusion proteins and component parts having at least 75%, at least 80%, at least 85%, at least 87%, at least 90%, at least 91%, at least 92%, at least 93%, at least 94%, at least 95%, at least 96%, at least 97%, at least 98%, at least 99% sequence identity to the amino acid sequences particularly disclosed herein. The terms "percent similarity," "percent identity," and "percent homology" when referring to a particular sequence are used as set forth in the University of Wisconsin GCG software program BestFit. Other algorithms may be used, e.g. BLAST, psiBLAST or TBLASTN (which use the method of Altschul et al. (1990) J. Mol. Biol. 215: 405-410), FASTA (which uses the method of Pearson and Lipman (1988) PNAS USA 85: 2444-2448).

Particular amino acid sequence variants may differ from a reference sequence by insertion, addition, substitution or deletion of 1 amino acid, 2, 3, 4, 5-10, 10-20 or 20-30 amino acids. In some embodiments, a variant sequence may comprise the reference sequence with 1, 2, 3, 4, 5, 6, 7, 8, 9, 10 or more residues inserted, deleted or substituted. For example, 5, 10, 15, up to 20, up to 30 or up to 40 residues may be inserted, deleted or substituted.

In some preferred embodiments, a variant may differ from a reference sequence by 1, 2, 3, 4, 5, 6, 7, 8, 9, 10 or more conservative substitutions. Conservative substitutions involve the replacement of an amino acid with a different amino acid having similar properties. For example, an aliphatic residue may be replaced by another aliphatic residue, a non-polar residue may be replaced by another non-polar residue, an acidic residue may be replaced by another acidic residue, a basic residue may be replaced by another basic residue, a polar residue may be replaced by another polar residue or an aromatic residue may be replaced by another aromatic residue. Conservative substitutions may, for example, be between amino acids within the following groups: Conservative substitutions are shown in Table 6 below.

TABLE 6

Amino Acid Substitutions

| Original Residue | Exemplary Substitutions | Preferred Substitutions |
|---|---|---|
| Ala (A) | Val; Leu; Ile | Val |
| Arg (R) | Lys; Gln; Asn | Lys |
| Asn (N) | Gln; His; Asp; Lys; Arg | Gln |
| Asp (D) | Glu; Asn | Glu |
| Cys (C) | Ser; Ala | Ser |
| Gln (Q) | Asn; Glu | Asn |
| Glu (E) | Asp; Gln | Asp |
| Gly (G) | Ala | Ala |
| His (H) | Asn; Gln; Lys; Arg | Arg |
| Ile (I) | Leu; Val; Met; Ala; Phe; Norleucine | Leu |
| Leu (L) | Norleucinne; Ile; Val; Met; Ala; Phe | He |
| Lys (K) | Arg; Gln; Asn | Arg |
| Met (M) | Leu; Phe; Ile | Leu |
| Phe (F) | Trp; Leu; Val; Ile; Ala; Tyr | Tyr |
| Pro (P) | Ala | Ala |
| Ser (S) | Thr | Thr |
| Thr (T) | Val; Ser | Ser |
| Trp (W) | Tyr; Phe | Tyr |
| Tyr (Y) | Trp; Phe; Thr; Ser | Phe |
| Val (V) | Ile; Leu; Met; Phe; Ala; Norleucine | Leu |

Amino acids may be grouped into different classes according to common side-chain properties: a. hydrophobic: Norleucine, Met, Ala, Val, Leu, Ile; b. neutral hydrophilic: Cys, Ser, Thr, Asn, Gln; c. acidic: Asp, Glu; d. basic: His, Lys, Arg; e. residues that influence chain orientation: Gly, Pro; aomatic: Trp, Tyr, Phe. Non-conservative substitutions will entail exchanging a member of one of these classes for another class.

Cells

The cells may be any lymphocyte that is useful in adoptive cell therapy, such as a T-cell or a natural killer (NK) cell, an NKT cell, a gamma/delta T-cell or T regulatory cell. The cells may be allogeneic or autologous to the patient.

T cells or T lymphocytes are a type of lymphocyte that have a central role in cell-mediated immunity. They can be distinguished from other lymphocytes, such as B cells and natural killer cells (NK cells), by the presence of a T-cell receptor (TCR) on the cell surface. There are various types of T cell, as summarised below. Cytotoxic T cells (TC cells, or CTLs) destroy virally infected cells and tumor cells, and are also implicated in transplant rejection. CTLs express the CD8 molecule at their surface.

These cells recognize their targets by binding to antigen associated with MHC class I, which is present on the surface of all nucleated cells. Through IL-10, adenosine and other molecules secreted by regulatory T cells, the CD8+ cells can be inactivated to an anergic state, which prevent autoimmune diseases such as experimental autoimmune encephalomyelitis.

Memory T cells are a subset of antigen-specific T cells that persist long-term after an infection has resolved. They quickly expand to large numbers of effector T cells upon re-exposure to their cognate antigen, thus providing the immune system with "memory" against past infections. Memory T cells comprise three subtypes: central memory T cells (TCM cells) and two types of effector memory T cells (TEM cells and TEMRA cells). Memory cells may be either CD4+ or CD8+. Memory T cells typically express the cell surface protein CD45RO. Regulatory T cells (Treg cells), formerly known as suppressor T cells, are crucial for the maintenance of immunological tolerance. Their major role is to shut down T cell-mediated immunity toward the end of an immune reaction and to suppress auto-reactive T cells that escaped the process of negative selection in the thymus.

Two major classes of CD4+ Treg cells have been described—naturally occurring Treg cells and adaptive Treg cells. Naturally occurring Treg cells (also known as $CD4^+CD25^+FoxP3^+$ Treg cells) arise in the thymus and have been linked to interactions between developing T cells with both myeloid ($CD11c^+$) and plasmacytoid ($CD123^+$) dendritic cells that have been activated with TSLP. Naturally occurring Treg cells can be distinguished from other T cells by the presence of an intracellular molecule called FoxP3. Adaptive Treg cells (also known as Tr1 cells or Th3 cells) may originate during a normal immune response.

Natural Killer Cells (or NK cells) are a type of cytolytic cell which form part of the innate immune system. NK cells provide rapid responses to innate signals from virally infected cells in an MHC independent manner. NK cells (belonging to the group of innate lymphoid cells) are defined as large granular lymphocytes (LGL) and constitute the third kind of cells differentiated from the common lymphoid progenitor generating B and T lymphocytes.

In some embodiments, therapeutic cells comprise autologous cells engineered to express a CoStAR. In some embodiments, therapeutic cells comprise allogeneic cells engineered to express a CoStAR. Autologous cells expressing CoStARs may be advantageous in avoiding graft-versus-host disease (GVHD) due to TCR-mediated recognition of recipient alloantigens. Also, the immune system of a CoStAR recipient could attack the infused CoStAR cells, causing rejection. In certain embodiments, to prevent GVHD, and to reduce rejection, endogenous TcR is removed from allogeneic CoStAR cells by genome editing.

Nucleic Acids

In some embodiments, provided is a nucleic acid sequence encoding any of the CoStARs, polypeptides, or proteins described herein (including functional portions and functional variants thereof). As used herein, the terms "polynucleotide", "nucleotide", and "nucleic acid" are intended to be synonymous with each other. It will be understood by a skilled person that numerous different polynucleotides and nucleic acids can encode the same polypeptide as a result of the degeneracy of the genetic code. In addition, it is to be understood that skilled persons may, using routine techniques, make nucleotide substitutions that do not affect the polypeptide sequence encoded by the polynucleotides described here to reflect the codon usage of any particular host organism in which the polypeptides are to be expressed, e.g. codon optimisation. Nucleic acids may comprise DNA or RNA. They may be single stranded or double-stranded. They may also be polynucleotides which include within them synthetic or modified nucleotides. A number of different types of modification to oligonucleotides are known in the art. These include methylphosphonate and phosphorothioate backbones, addition of acridine or polylysine chains at the 3' and/or 5' ends of the molecule. For the purposes of the present disclosure, it is to be understood that the polynucleotides may be modified by any method available in the art. Such modifications may be carried out in order to enhance the in vivo activity or life span of polynucleotides of interest.

The terms "variant", "homologue" or "derivative" in relation to a nucleotide sequence include any substitution of, variation of, modification of, replacement of, deletion of or addition of one (or more) nucleic acid from or to the sequence.

The nucleic acid sequence may encode the CoStAR and/or fusion proteins including without limitation any one of SEQ ID NOS:42-247 or SEQ ID NOS:196-335, or a variant thereof. The nucleotide sequence may comprise a codon optimised nucleic acid sequence shown engineered for expression in human cells.

Provided is a nucleic acid sequence which comprises a nucleic acid sequence encoding a CoStAR and a further nucleic acid sequence encoding a T-cell receptor (TCR) and/or chimeric antigen receptor (CAR).

The nucleic acid sequences may be joined by a sequence allowing co-expression of the two or more nucleic acid sequences. For example, the construct may comprise an internal promoter, an internal ribosome entry sequence (IRES) sequence or a sequence encoding a cleavage site. The cleavage site may be self-cleaving, such that when the polypeptide is produced, it is immediately cleaved into the discrete proteins without the need for any external cleavage activity. Various self-cleaving sites are known, including the Foot- and Mouth disease virus (FMDV) and the 2A self-cleaving peptide. The co-expressing sequence may be an internal ribosome entry sequence (IRES). The co-expressing sequence may be an internal promoter.

Vectors

In some embodiments, provided is a vector which comprises a nucleic acid sequence or nucleic acid.

Such a vector may be used to introduce the nucleic acid sequence(s) or nucleic acid construct(s) into a host cell so that it expresses one or more CoStAR(s) according to the first aspect of the invention and, optionally, one or more other proteins of interest (POI), for example a TCR or a CAR. The vector may, for example, be a plasmid or a viral vector, such as a retroviral vector or a lentiviral vector, or a transposon-based vector or synthetic mRNA.

The nucleic acids of the present invention may also be used for nucleic acid immunization and gene therapy, using standard gene delivery protocols. Methods for gene delivery are known in the art. See, e.g., U.S. Pat. Nos. 5,399,346, 5,580,859, 5,589,466, incorporated by reference herein in their entireties.

Vectors derived from retroviruses, such as the lentivirus, are suitable tools to achieve long-term gene transfer since they allow long-term, stable integration of a transgene or transgenes and its propagation in daughter cells. The vector may be capable of transfecting or transducing a lymphocyte including a T cell or an NK cell. Also provided are vectors in which a nucleic acid as provided herein is inserted. The expression of natural or synthetic nucleic acids encoding a CoStAR, and optionally a TCR or CAR is typically achieved by operably linking a nucleic acid encoding the CoStAR and TCR/CAR polypeptide or portions thereof to one or more promoters, and incorporating the construct into an expression vector.

Additional promoter elements, e.g., enhancers, regulate the frequency of transcriptional initiation. Typically, these are located in the region 30-110 bp upstream of the start site, although a number of promoters have recently been shown to contain functional elements downstream of the start site as well. The spacing between promoter elements frequently is flexible, so that promoter function is preserved when elements are inverted or moved relative to one another. In the thymidine kinase (tk) promoter, the spacing between promoter elements can be increased to 50 bp apart before activity begins to decline.

One example of a suitable promoter is the immediate early cytomegalovirus (CMV) promoter sequence. This promoter sequence is a strong constitutive promoter sequence capable of driving high levels of expression of any polynucleotide sequence operatively linked thereto. Another example of a suitable promoter is Elongation Growth Factor-1α (EF-1α). However, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, MSCV promoter, MND promoter, an avian leukemia virus promoter, an Epstein-Barr virus immediate early promoter, a Rous sarcoma virus promoter, as well as human gene promoters such as, but not limited to, the actin promoter, the myosin promoter, the hemoglobin promoter, and the creatine kinase promoter.

The vectors can be suitable for replication and integration in eukaryotic cells. Typical cloning vectors contain transcription and translation terminators, initiation sequences, and promoters useful for regulation of the expression of the desired nucleic acid sequence. Viral vector technology is well known in the art and is described, for example, in Sambrook et al. (2001, Molecular Cloning: A Laboratory Manual, Cold Spring Harbor Laboratory, New York), and in other virology and molecular biology manuals, see also, WO 01/96584; WO 01/29058; and U.S. Pat. No. 6,326,193). In some embodiments, the constructs expressed are as shown in SEQ ID NOS:42-247, or 196-335, 362-363, 369-420, and 514. In some embodiments the nucleic acids are multicistronic constructs that permit the expression of multiple transgenes (e.g., CoStAR and a TCR and/or CAR etc.) under the control of a single promoter. In some embodiments, the transgenes (e.g., CoStAR and a TCR and/or CAR etc.) are separated by a self-cleaving 2A peptide. Examples of 2A peptides useful in the nucleic acid constructs of the include F2A, P2A, T2A and E2A. In other embodiments, the nucleic acid construct is a multi-cistronic construct comprising two promoters; one promoter driving the expression of CoStAR and the other promoter driving the expression of the TCR or CAR. In some embodiments, the dual promoter constructs are uni-directional. In some embodiments, the dual promoter constructs are bi-directional. In order to assess the expression of the CoStAR polypeptide or portions thereof, the expression vector to be introduced into a cell can also contain either a selectable marker gene or a reporter gene or both to facilitate identification and selection of expressing cells from the population of cells sought to be transfected or transduced through viral vectors.

Sources of Cells

Prior to expansion and genetic modification, a source of cells (e.g., immune effector cells, e.g., T cells or NK cells) is obtained from a subject. The term "subject" is intended to include living organisms in which an immune response can be elicited (e.g., mammals). Examples of subjects include humans, dogs, cats, mice, rats, and transgenic species thereof. T cells can be obtained from a number of sources, including peripheral blood mononuclear cells, bone marrow, lymph node tissue, cord blood, thymus tissue, tissue from a site of infection, ascites, pleural effusion, spleen tissue, and tumors.

In one aspect, T cells are isolated from peripheral blood lymphocytes by lysing the red blood cells and depleting the monocytes, for example, by centrifugation through a PERCOLL™ gradient or by counterflow centrifugal elutriation. T cell may be collected at an apheresis center and cell storage facility where T cells can be harvested, maintained, and easily transferred. The T cells can be cryopreserved and stored for later use. An acceptable duration of storage may be determined and validated and can be up to 6 months, up to a year, or longer.

In another aspect, Tumor infiltrating cells (TILs) are isolated and/or expanded from a tumor, for example by a fragmented, dissected, or enzyme digested tumor biopsy or mass. The TILs may be produced in a two-stage process using a tumor biopsy as the starting material: Stage 1 (generally performed over 2-3 hours) initial collection and processing of tumor material using dissection, enzymatic digestion and homogenization to produce a single cell suspension which can be directly cryopreserved to stabilize the starting material for subsequent manufacture and Stage 2 which can occur days or years later. Stage 2 may be performed over 4 weeks, which may be a continuous process starting with thawing of the product of Stage 1 and growth of the TIL out of the tumor starting material (about 2 weeks) followed by a rapid expansion process of the TIL cells (about 2 weeks) to increase the amount of cells and therefore dose. The TILs maybe concentrated and washed prior to formulation as a liquid suspension of cells.

The TIL population can be transduced at any point following collection. In some embodiments, a cryopreserved TIL population is transduced to express a CoStAR following thawing. In some embodiments, a TIL population is transduced to express a CoStAR during outgrowth or initial expansion from tumor starting material. In some embodiments, a TIL population is transduced to express a CoStAR during REP, for example but not limited to from about day 8 to about day 10 of REP. An exemplary TIL preparation is described in Applicant's U.S. patent application Ser. No. 62/951,559, filed Dec. 20, 2019.

A specific subpopulation of T cells, such as CD3+, CD28+, CD4+, CD8+, CD45RA+, and CD45RO+ T cells, can be further isolated by positive or negative selection techniques. For example, in one aspect, T cells are isolated by incubation with anti-CD3/anti-CD28-conjugated beads, such as DYNABEADS® M-450 CD3/CD28 T, for a time period sufficient for positive selection of the desired T cells. In one aspect, the time period is about 30 minutes. In a further aspect, the time period ranges from 30 minutes to 36 hours or longer and all integer values there between. In a further aspect, the time period is at least 1, 2, 3, 4, 5, or 6 hours. In yet another preferred aspect, the time period is 10 to 24 hours. In one aspect, the incubation time period is 24 hours. Longer incubation times may be used to isolate T cells in any situation where there are few T cells as compared to other cell types, such in isolating tumor infiltrating lymphocytes (TIL) from tumor tissue or from immunocompromised individuals. Further, use of longer incubation times can increase the efficiency of capture of CD8+ T cells. Thus, by simply shortening or lengthening the time T cells are allowed to bind to the CD3/CD28 beads and/or by increasing or decreasing the ratio of beads to T cells (as described further herein), subpopulations of T cells can be preferentially selected for or against at culture initiation or at other time points during the process. Additionally, by increasing or decreasing the ratio of anti-CD3 and/or anti-CD28 antibodies on the beads or other surface, subpopulations of T cells can be preferentially selected for or against at culture initiation or at other desired time points. The skilled artisan would recognize that multiple rounds of selection can also be used in the context of this disclosure. In certain aspects, it may be desirable to perform the selection procedure and use the "unselected" cells in the activation and expansion process. "Unselected" cells can also be subjected to further rounds of selection.

Enrichment of a T cell population by negative selection can be accomplished with a combination of antibodies directed to surface markers unique to the negatively selected cells. One method is cell sorting and/or selection via negative magnetic immunoadherence or flow cytometry that uses a cocktail of monoclonal antibodies directed to cell surface markers present on the cells negatively selected. For example, to enrich for CD4+ cells by negative selection, a monoclonal antibody cocktail typically includes antibodies to CD14, CD20, CD16, HLA-DR, and CD8. In certain aspects, it may be desirable to enrich for or positively select for regulatory T cells which typically express CD4+, CD25+, CD62Lhi, GITR+, CD137, PD1, TIM3, LAG-3, CD150 and FoxP3+. Alternatively, in certain aspects, T regulatory cells are depleted by anti-CD25 conjugated beads or other similar method of selection.

The methods described herein can include, e.g., selection of a specific subpopulation of immune effector cells, e.g., T cells, that are a T regulatory cell-depleted population, CD25+ depleted cells, using, e.g., a negative selection technique, e.g., described herein. Preferably, the population of T regulatory depleted cells contains less than 30%, 25%, 20%, 15%, 10%, 5%, 4%, 3%, 2%, 1% of CD25+ cells.

A specific subpopulation of CoStAR effector cells that specifically bind to a target antigen can be enriched for by positive selection techniques. For example, in some embodiments, effector cells are enriched for by incubation with target antigen-conjugated beads for a time period sufficient for positive selection of the desired abTCR effector cells. In some embodiments, the time period is about 30 minutes. In some embodiments, the time period ranges from 30 minutes to 36 hours or longer (including all ranges between these values). In some embodiments, the time period is at least one, 2, 3, 4, 5, or 6 hours. In some embodiments, the time period is 10 to 24 hours. In some embodiments, the incubation time period is 24 hours. For isolation of effector cells present at low levels in the heterogeneous cell population, use of longer incubation times, such as 24 hours, can increase cell yield. Longer incubation times may be used to isolate effector cells in any situation where there are few effector cells as compared to other cell types. The skilled artisan would recognize that multiple rounds of selection can also be used in the context of this disclosure.

T cells for stimulation can also be frozen after a washing step. After the washing step that removes plasma and platelets, the cells may be suspended in a freezing solution. While many freezing solutions and parameters are known in the art and will be useful in this context, one method involves using PBS containing 20% DMSO and 8% human serum albumin, or culture media containing 10% Dextran 40 and 5% Dextrose, 20% Human Serum Albumin and 7.5% DMSO, or 31.25% Plasmalyte-A, 31.25% Dextrose 5%, 0.45% NaCl, 10% Dextran 40 and 5% Dextrose, 20% Human Serum Albumin, and 7.5% DMSO or other suitable cell freezing media containing for example, Hespan and PlasmaLyte A, the cells then are frozen to −80° C. at a rate of 1° per minute and stored in the vapor phase of a liquid nitrogen storage tank. Other methods of controlled freezing may be used as well as uncontrolled freezing immediately at −20° C. or in liquid nitrogen.

Allogeneic CoStAR

In embodiments described herein, the immune effector cell can be an allogeneic immune effector cell, e.g., T cell or NK cell. For example, the cell can be an allogeneic T cell, e.g., an allogeneic T cell lacking expression of endogenous T cell receptor (TCR) and/or human leukocyte antigen (HLA), e.g., HLA class I and/or HLA class II.

A T cell lacking a functional endogenous TCR can be, e.g., engineered such that it does not express any functional TCR on its surface, engineered such that it does not express one or more subunits that comprise a functional TCR (e.g., engineered such that it does not express (or exhibits reduced expression) of TCR alpha, TCR beta, TCR gamma, TCR delta, TCR epsilon, and/or TCR zeta) or engineered such that it produces very little functional TCR on its surface. Alternatively, the T cell can express a substantially impaired TCR, e.g., by expression of mutated or truncated forms of one or more of the subunits of the TCR. The term "substantially impaired TCR" means that this TCR will not elicit an adverse immune reaction in a host.

A T cell described herein can be, e.g., engineered such that it does not express a functional HLA on its surface. For example, a T cell described herein, can be engineered such that cell surface expression HLA, e.g., HLA class 1 and/or HLA class II, is downregulated. In some aspects, downregulation of HLA may be accomplished by reducing or eliminating expression of beta-2 microglobulin (B2M).

In some embodiments, the T cell can lack a functional TCR and a functional HLA, e.g., HLA class I and/or HLA class II. Modified T cells that lack expression of a functional TCR and/or HLA can be obtained by any suitable means, including a knock out or knock down of one or more subunit of TCR or HLA. For example, the T cell can include a knock down of TCR and/or HLA using siRNA, shRNA, clustered regularly interspaced short palindromic repeats (CRISPR) transcription-activator like effector nuclease (TALEN), or zinc finger endonuclease (ZFN).

In some embodiments, the allogeneic cell can be a cell which does not expresses or expresses at low levels an inhibitory molecule, e.g. a cell engineered by any method described herein. For example, the cell can be a cell that does not express or expresses at low levels an inhibitory molecule, e.g., that can decrease the ability of a CoStAR-expressing cell to mount an immune effector response. Examples of inhibitory molecules include PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, Gal9, adenosine, and TGFR beta. Inhibition of an inhibitory molecule, e.g., by inhibition at the DNA, RNA or protein level, can optimize a CAR-expressing cell performance. In embodiments, an inhibitory nucleic acid, e.g., an inhibitory nucleic acid, e.g., a dsRNA, e.g., an siRNA or shRNA, a clustered regularly interspaced short palindromic repeats (CRISPR), a transcription-activator like effector nuclease (TALEN), or a zinc finger endonuclease (ZFN), e.g., as described herein, can be used.

Use of siRNA or shRNA to Inhibit Endogenous TCR or HLA

In some embodiments, TCR expression and/or HLA expression can be inhibited using siRNA or shRNA that targets a nucleic acid encoding a TCR and/or HLA, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, Gal9, adenosine, and TGFR beta), in a T cell.

Expression of siRNA and shRNAs in T cells can be achieved using any conventional expression system, e.g., such as a lentiviral expression system. Exemplary shRNAs that downregulate expression of components of the TCR are described, e.g., in US Publication No.: 2012/0321667. Exemplary siRNA and shRNA that downregulate expression of HLA class I and/or HLA class II genes are described, e.g., in U.S. publication No.: US 2007/0036773.

CRISPR to Inhibit TCR or HLA

"CRISPR" or "CRISPR to inhibit TCR and/or HLA" as used herein refers to a set of clustered regularly interspaced short palindromic repeats, or a system comprising such a set of repeats. "Cas", as used herein, refers to a CRISPR-associated protein. A "CRISPR/Cas" system refers to a system derived from CRISPR and Cas which can be used to silence or mutate a TCR and/or HLA gene, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta).

Naturally-occurring CRISPR/Cas systems are found in approximately 40% of sequenced eubacteria genomes and 90% of sequenced archaea. Grissa et al. (2007) BMC Bioinfonuatics 8: 172. This system is a type of prokaryotic immune system that confers resistance to foreign genetic elements such as plasmids and phages and provides a form of acquired immunity. Barrangou et al. (2007) Science 315: 1709-1712; Marragini et al. (2008) Science 322: 1843-1845.

In some embodiments, the fusion protein or CoSTaR comprises polypeptides of SEQ ID NO: 192, 210, 228, 246, 264, 282, and/or any one of SEQ ID NO: 348 where the sequences are shown in Table 7. In some embodiments, this includes some part of SEQ ID NO: 192, 210, 228, 246, 264, 282 and/or parts of SEQ ID NO: 348, and/or variants thereof. In some embodiments, the fusion protein or CoSTaR comprises the CEA construct components provided in FIG. 83 (all or in part or variants thereof). In some embodiments, the fusion protein or CoSTaR comprises the MSLN construct components provided in FIG. 84 (all or in part or variants thereof). In some embodiments, this includes SEQ ID Nos: 83 (all or in part or variants thereof). In some embodiments, this includes SEQ ID Nos: 84 (all or in part or variants thereof). In some embodiments, the fusion protein or CoStAR will be the same as shown in Table 7, with the binding domain (such as an scFv) to MSLN or CEA.

In some embodiments, a cancer specific CAR or TCR is present in the cell that contains the fusion protein or CoStAR. In some embodiments, a fusion protein or CoStAR can be expressed alone under the control of a promoter in a therapeutic population of cells that have therapeutic activity, for example, Tumor Infiltrating Lymphocytes (TILs). In some embodiments, the fusion protein or CoStAR can be expressed along with a therapeutic transgene such as a chimeric antigen receptor (CAR) and/or T-cell Receptor (TCR).

In some embodiments, suitable TCRs and CARs can be those that are well known in the literature, for example HLA-A*02-NYES0-1 specific TCRs (Rapoport et al. Nat Med 2015) or anti-CD19scFv.CD3z fusion CARs (Kochenderfer et al. J Clin Oncol 2015) which have been successfully used to treat Myeloma or B-cell malignancies respectively. In some embodiments, the CoStARs described herein can be expressed with any known CAR or TCR thus providing the cell with a regulatable growth switch to allow cell expansion in-vitro or in-vivo, and a conventional activation mechanism in the form of the TCR or CAR for anti-cancer activity. In some embodiments, a cell for use in adoptive cell therapy is provided and comprises a CoStAR as described herein and a TCR and/or CAR that specifically binds to a tumor associated antigen. In some embodiments, an exemplary CoStAR comprising CD28 includes an extracellular antigen binding domain and an extracellular, transmembrane and intracellular signaling domain.

Activation and Expansion of T Cells

T cells may be activated and expanded generally using methods as described, for example, in U.S. Pat. Nos. 6,352,694; 6,534,055; 6,905,680; 6,692,964; 5,858,358; 6,887,466; 6,905,681; 7,144,575; 7,067,318; 7,172,869; 7,232,566; 7,175,843; 5,883,223; 6,905,874; 6,797,514; 6,867,041; and U.S. Patent Application Publication No. 20060121005.

Generally, the T cells may be expanded by contact with a surface having attached thereto an agent that stimulates a CD3/TCR complex associated signal and a ligand that stimulates a costimulatory molecule on the surface of the T cells. In particular, T cell populations may be stimulated as described herein, such as by contact with an anti-CD3 antibody, or antigen-binding fragment thereof, or an anti-CD2 antibody immobilized on a surface, or by contact with a protein kinase C activator (e.g., bryostatin) in conjunction with a calcium ionophore. For co-stimulation of an accessory molecule on the surface of the T cells, a ligand that binds the accessory molecule is used. For example, a population of T cells can be contacted with an anti-CD3 antibody and an anti-CD28 antibody, under conditions appropriate for stimulating proliferation of the T cells. To stimulate proliferation of either CD4+ T cells or CD8+ T cells, an anti-CD3 antibody and an anti-CD28 antibody can be used. Examples of an anti-CD28 antibody include 9.3, B-T3, XR-CD28 (Diaclone, Besancon, France) can be used as can other methods commonly known in the art (Berg et al., Transplant Proc. 30(8):3975-3977, 1998; Haanen et al., J. Exp. Med. 190(9):13191328, 1999; Garland et al., J. Immunol Meth. 227(1-2):53-63, 1999).

In some embodiments, expansion can be performed using flasks or containers, or gas-permeable containers known by those of skill in the art and can proceed for 7 days, 8 days, 9 days, 10 days, 11 days, 12 days, 13 days, or 14 days, about 7 days to about 14 days, about 8 days to about 14 days, about 9 days to about 14 days, about 10 days to about 14 days, about 11 days to about 14 days, about 12 days to about 14 days, or about 13 days to about 14 days. In some embodiments, the second TIL expansion can proceed for about 14 days.

In some embodiments, the expansion can be performed using non-specific T-cell receptor stimulation in the presence of interleukin-2 (IL-2) or interleukin-15 (IL-15). The non-specific T-cell receptor stimulus can include, for example, an anti-CD3 antibody, such as about 30 ng/ml of OKT3, a mouse monoclonal anti-CD3 antibody (commercially available from Ortho-McNeil, Raritan, N.J. or Miltenyi Biotech, Auburn, Calif.) or UHCT-1 (commercially available from BioLegend, San Diego, Calif., USA). CoStAR cells can be expanded in vitro by including one or more antigens, including antigenic portions thereof, such as epitope(s), of a cancer, which can be optionally expressed from a vector, such as a human leukocyte antigen A2 (HLA-A2) binding peptide, e.g., 0.3.mu.M MART-1:26-35 (27L) or gp100:209-217 (210M), optionally in the presence of a T-cell growth factor, such as 300 IU/mL IL-2 or IL-15. Other suitable antigens may include, e.g., NY-ESO-1, TRP-1, TRP-2, tyrosinase cancer antigen, MAGE-A3, SSX-2, and VEGFR2, or antigenic portions thereof. CoStAR cells may also be rapidly expanded by re-stimulation with the same antigen(s) of the cancer pulsed onto HLA-A2-expressing antigen-presenting cells. Alternatively, the CoStAR cells can be further stimulated with, e.g., example, irradiated, autologous lymphocytes or with irradiated HLA-A2+ allogeneic lymphocytes and IL-2. In some embodiments, the stimulation occurs as part of the expansion. In some embodiments, the expansion occurs in the presence of irradiated, autologous lymphocytes or with irradiated HLA-A2+ allogeneic lymphocytes and IL-2.

In some embodiments, the cell culture medium comprises IL-2. In some embodiments, the cell culture medium comprises about 1000 IU/mL, about 1500 IU/mL, about 2000 IU/mL, about 2500 IU/mL, about 3000 IU/mL, about 3500 IU/mL, about 4000 IU/mL, about 4500 IU/mL, about 5000 IU/mL, about 5500 IU/mL, about 6000 IU/mL, about 6500 IU/mL, about 7000 IU/mL, about 7500 IU/mL, or about 8000 IU/mL, or between 1000 and 2000 IU/mL, between 2000 and 3000 IU/mL, between 3000 and 4000 IU/mL, between 4000 and 5000 IU/mL, between 5000 and 6000 IU/mL, between 6000 and 7000 IU/mL, between 7000 and 8000 IU/mL, or between 8000 IU/mL of IL-2.

In some embodiments, the cell culture medium comprises OKT3 antibody. In some embodiments, the cell culture medium comprises about 0.1 ng/mL, about 0.5 ng/mL, about 1 ng/mL, about 2.5 ng/mL, about 5 ng/mL, about 7.5 ng/mL, about 10 ng/mL, about 15 ng/mL, about 20 ng/mL, about 25 ng/mL, about 30 ng/mL, about 35 ng/mL, about 40 ng/mL, about 50 ng/mL, about 60 ng/mL, about 70 ng/mL, about 80 ng/mL, about 90 ng/mL, about 100 ng/mL, about 200 ng/mL, about 500 ng/mL, about 1 µg/mL or between 0.1 ng/mL and 1 ng/mL, between 1 ng/mL and 5 ng/mL, between 5 ng/mL and 10 ng/mL, between 10 ng/mL and 20 ng/mL, between 20 ng/mL and 30 ng/mL, between 30 ng/mL and 40 ng/mL, between 40 ng/mL and 50 ng/mL, or between 50 ng/mL and 100 ng/mL of OKT3 antibody.

In some embodiments, a combination of IL-2, IL-7, IL-15, and/or IL-21 are employed as a combination during the expansion. In some embodiments, IL-2, IL-7, IL-15, and/or IL-21 as well as any combinations thereof can be included during the expansion. In some embodiments, a combination of IL-2, IL-15, and IL-21 are employed as a combination during the expansion. In some embodiments, IL-2, IL-15, and IL-21 as well as any combinations thereof can be included.

In some embodiments, the expansion can be conducted in a supplemented cell culture medium comprising IL-2, OKT-3, and antigen-presenting feeder cells.

In some embodiments, the expansion culture media comprises about 500 IU/mL of IL-15, about 400 IU/mL of IL-15, about 300 IU/mL of IL-15, about 200 IU/mL of IL-15, about 180 IU/mL of IL-15, about 160 IU/mL of IL-15, about 140 IU/mL of IL-15, about 120 IU/mL of IL-15, or about 100 IU/mL of IL-15, or about 500 IU/mL of IL-15 to about 100 IU/mL of IL-15, or about 400 IU/mL of IL-15 to about 100 IU/mL of IL-15 or about 300 IU/mL of IL-15 to about 100 IU/mL of IL-15 or about 200 IU/mL of IL-15, or about 180 IU/mL of IL-15.

In some embodiments, the expansion culture media comprises about 20 IU/mL of IL-21, about 15 IU/mL of IL-21, about 12 IU/mL of IL-21, about 10 IU/mL of IL-21, about 5 IU/mL of IL-21, about 4 IU/mL of IL-21, about 3 IU/mL of IL-21, about 2 IU/mL of IL-21, about 1 IU/mL of IL-21, or about 0.5 IU/mL of IL-21, or about 20 IU/mL of IL-21 to about 0.5 IU/mL of IL-21, or about 15 IU/mL of IL-21 to about 0.5 IU/mL of IL-21, or about 12 IU/mL of IL-21 to about 0.5 IU/mL of IL-21, or about 10 IU/mL of IL-21 to about 0.5 IU/mL of IL-21, or about 5 IU/mL of IL-21 to about 1 IU/mL of IL-21, or about 2 IU/mL of IL-21. In some embodiments, the cell culture medium comprises about 1 IU/mL of IL-21, or about 0.5 IU/mL of IL-21.

In some embodiments the antigen-presenting feeder cells (APCs) are PBMCs. In an embodiment, the ratio of CoStAR cells to PBMCs and/or antigen-presenting cells in the expansion is about 1 to 25, about 1 to 50, about 1 to 100, about 1 to 125, about 1 to 150, about 1 to 175, about 1 to 200, about 1 to 225, about 1 to 250, about 1 to 275, about 1 to 300, about 1 to 325, about 1 to 350, about 1 to 375, about 1 to 400, or about 1 to 500, or between 1 to 50 and 1 to 300, or between 1 to 100 and 1 to 200.

In certain aspects, the primary stimulatory signal and the costimulatory signal for the T cell may be provided by different protocols. For example, the agents providing each signal may be in solution or coupled to a surface. When coupled to a surface, the agents may be coupled to the same surface (i.e., in "cis" formation) or to separate surfaces (i.e., in "trans" formation). Alternatively, one agent may be coupled to a surface and the other agent in solution. In one aspect, the agent providing the costimulatory signal is bound to a cell surface and the agent providing the primary activation signal is in solution or coupled to a surface. In certain aspects, both agents can be in solution. In one aspect, the agents may be in soluble form, and then cross-linked to a surface, such as a cell expressing Fc receptors or an antibody or other binding agent which will bind to the agents. In this regard, see for example, U.S. Patent Application Publication Nos. 20040101519 and 20060034810 for artificial antigen presenting cells (aAPCs) that are contemplated for use in activating and expanding T cells in the present disclosure.

In one aspect, the two agents are immobilized on beads, either on the same bead, i.e., "cis," or to separate beads, i.e., "trans." By way of example, the agent providing the primary activation signal is an anti-CD3 antibody or an antigen-binding fragment thereof and the agent providing the costimulatory signal is an anti-CD28 antibody or antigen-binding fragment thereof; and both agents are co-immobilized to the same bead in equivalent molecular amounts. In one aspect, a 1:1 ratio of each antibody bound to the beads for CD4+ T cell expansion and T cell growth is used. In some embodiments, a ratio of anti CD3:CD28 antibodies bound to the beads is used such that an increase in T cell expansion is observed as compared to the expansion observed using a ratio of 1:1. In one particular aspect an increase of from about 1 to about 3 fold is observed as compared to the expansion observed using a ratio of 1:1. In one aspect, the ratio of CD3:CD28 antibody bound to the beads ranges from 100:1 to 1:100 and all integer values there between. In some embodiments, more anti-CD28 antibody is bound to the particles than anti-CD3 antibody, i.e., the ratio of CD3:CD28 is less than one. In some embodiments, the ratio of anti CD28 antibody to anti CD3 antibody bound to the beads is greater than 2:1. In one particular aspect, a 1:100 CD3:CD28 ratio of antibody bound to beads is used. In one aspect, a 1:75 CD3:CD28 ratio of antibody bound to beads is used. In a further aspect, a 1:50 CD3:CD28 ratio of antibody bound to beads is used. In one aspect, a 1:30 CD3:CD28 ratio of antibody bound to beads is used. In one preferred aspect, a 1:10 CD3:CD28 ratio of antibody bound to beads is used. In one aspect, a 1:3 CD3:CD28 ratio of antibody bound to the beads is used. In yet one aspect, a 3:1 CD3:CD28 ratio of antibody bound to the beads is used.

Ratios of particles to cells from 1:500 to 500:1 and any integer values in between may be used to stimulate T cells or other target cells. As those of ordinary skill in the art can readily appreciate, the ratio of particles to cells may depend on particle size relative to the target cell. For example, small sized beads could only bind a few cells, while larger beads could bind many. In certain aspects the ratio of cells to particles ranges from 1:100 to 100:1 and any integer values in-between and in further aspects the ratio comprises 1:9 to 9:1 and any integer values in between, can also be used to stimulate T cells. The ratio of anti-CD3- and anti-CD28-coupled particles to T cells that result in T cell stimulation can vary as noted above, however certain preferred values include 1:100, 1:50, 1:40, 1:30, 1:20, 1:10, 1:9, 1:8, 1:7, 1:6, 1:5, 1:4, 1:3, 1:2, 1:1, 2:1, 3:1, 4:1, 5:1, 6:1, 7:1, 8:1, 9:1, 10:1, and 15:1 with one preferred ratio being at least 1:1 particles per T cell. In one aspect, a ratio of particles to cells of 1:1 or less is used. In one particular aspect, a preferred particle:cell ratio is 1:5. In further aspects, the ratio of particles to cells can be varied depending on the day of stimulation. For example, in one aspect, the ratio of particles to cells is from 1:1 to 10:1 on the first day and additional particles are added to the cells every day or every other day thereafter for up to 10 days, at final ratios of from 1:1 to 1:10 (based on cell counts on the day of addition). In one particular aspect, the ratio of particles to cells is 1:1 on the first day of stimulation and adjusted to 1:5 on the third and fifth days of stimulation. In one aspect, particles are added on a daily or every other day basis to a final ratio of 1:1 on the first day, and 1:5 on the third and fifth days of stimulation. In one aspect, the ratio of particles to cells is 2:1 on the first day of stimulation and adjusted to 1:10 on the third and fifth days of stimulation. In one aspect, particles are added on a daily or every other day basis to a final ratio of 1:1 on the first day, and 1:10 on the third and fifth days of stimulation. One of skill in the art will appreciate that a variety of other ratios may be suitable for use. In particular, ratios will vary depending on particle size and on cell size and type. In one aspect, the most typical ratios for use are in the neighborhood of 1:1, 2:1 and 3:1 on the first day.

In further aspects, the cells, such as T cells, are combined with agent-coated beads, the beads and the cells are subsequently separated, and then the cells are cultured. In an alternative aspect, prior to culture, the agent-coated beads and cells are not separated but are cultured together. In a further aspect, the beads and cells are first concentrated by application of a force, such as a magnetic force, resulting in increased ligation of cell surface markers, thereby inducing cell stimulation.

Preparation of CoStAR Cells

Viral- and non-viral-based genetic engineering tools can be used to generate CoStAR cells, including without limitation T cells, NK cells resulting in permanent or transient expression of therapeutic genes. Retrovirus-based gene delivery is a mature, well-characterized technology, which has been used to permanently integrate CARs into the host cell genome (Scholler J., e.g. Decade-long safety and function of retroviral-modified chimeric antigen receptor T cells. Sci. Transl. Med. 2012; 4:132ra53; Rosenberg S. A. et al., Gene transfer into humans—immunotherapy of patients with advanced melanoma, using tumor-infiltrating lymphocytes modified by retroviral gene transduction. N. Engl. J. Med. 1990; 323:570-578)

Non-viral DNA transfection methods can also be used. For example, Singh et al describes use of the Sleeping Beauty (SB) transposon system developed to engineer CAR T cells (Singh H., et al., Redirecting specificity of T-cell populations for CD19 using the Sleeping Beauty system. Cancer Res. 2008; 68:2961-2971) and is being used in clinical trials (see e.g., ClinicalTrials.gov: NCT00968760 and NCT01653717). The same technology is applicable to engineer CoStARs cells.

Multiple SB enzymes have been used to deliver transgenes. Mátés describes a hyperactive transposase (SB100×) with approximately 100-fold enhancement in efficiency when compared to the first-generation transposase. SB100X supported 35-50% stable gene transfer in human CD34(+) cells enriched in hematopoietic stem or progenitor cells. (Mátés L. et al., Molecular evolution of a novel hyperactive Sleeping Beauty transposase enables robust stable gene transfer in vertebrates. Nat. Genet. 2009; 41:753-761) and multiple transgenes can be delivered from multicistronic single plasmids (e.g., Thokala R. et al., Redirecting specificity of T cells using the Sleeping Beauty system to express chimeric antigen receptors by mix-and-matching of VL and VH domains targeting CD123+ tumors. PLoS ONE. 2016; 11:e0159477) or multiple plasmids (e.g., Hurton L. V. et al., Tethered IL-15 augments antitumor activity and promotes a stem-cell memory subset in tumor-specific T cells. Proc. Natl. Acad. Sci. USA. 2016; 113:E7788-E7797). Such systems are used with CoStARs.

Morita et al, describes the piggyBac transposon system to integrate larger transgenes (Morita D. et al., Enhanced expression of anti-CD19 chimeric antigen receptor in piggyBac transposon-engineered T cells. Mol. Ther. Methods Clin. Dev. 2017; 8:131-140) Nakazawa et al. describes use of the system to generate EBV-specific cytotoxic T-cells expressing HER2-specific chimeric antigen receptor (Nakazawa Y et al, PiggyBac-mediated cancer immunotherapy using EBV-specific cytotoxic T-cells expressing HER2-specific chimeric antigen receptor. Mol. Ther. 2011; 19:2133-2143). Manuri et al used the system to generate CD-19 specific T cells (Manuri P.V.R. et al., piggyBac transposon/transposase system to generate CD19-specific T cells for the treatment of B-lineage malignancies. Hum. Gene Ther. 2010; 21:427-437).

Transposon technology is easy and economical. One potential drawback is the longer expansion protocols currently employed may result in T cell differentiation, impaired activity and poor persistence of the infused cells. Monjezi et al describe development minicircle vectors that minimize these difficulties through higher efficiency integrations (Monjezi R. et al., Enhanced CAR T-cell engineering using non-viral Sleeping Beauty transposition from minicircle vectors. Leukemia. 2017; 31:186-194). These transposon technologies can be used for CoStARs.

Pharmaceutical Compositions

The present disclosure also provides a pharmaceutical composition containing a vector or a CoStAR expressing cell together with a pharmaceutically acceptable carrier, diluent or excipient, and optionally one or more further pharmaceutically active polypeptides and/or compounds.

In some embodiments, a pharmaceutical composition is provided comprising a CoStAR described above and a pharmaceutically acceptable carrier. In some embodiments, a pharmaceutical composition is provided comprising a nucleic acid encoding a CoStAR according to any of the embodiments described above and a pharmaceutically acceptable carrier. In some embodiments, a pharmaceutical composition is provided comprising an effector cell expressing a CoStAR described above and a pharmaceutically acceptable carrier. Such a formulation may, for example, be in a form suitable for intravenous infusion.

As used herein, by "pharmaceutically acceptable" or "pharmacologically compatible" is meant a material that is not biologically or otherwise undesirable, e.g., the material may be incorporated into a pharmaceutical composition administered to a patient without causing any significant undesirable biological effects or interacting in a deleterious manner with any of the other components of the composition in which it is contained. Pharmaceutically acceptable carriers or excipients have preferably met the required standards of toxicological and manufacturing testing and/or are included on the Inactive Ingredient Guide prepared by the U.S. Food and Drug administration.

In some embodiments, a population of modified T cells expressing a recombinant CoStAR is provided. A suitable population may be produced by a method described above.

The population of modified T cells may be for use as a medicament. For example, a population of modified T cells as described herein may be used in cancer immunotherapy therapy, for example adoptive T cell therapy.

Some embodiments provide the use of a population of modified T cells as described herein for the manufacture of a medicament for the treatment of cancer, a population of modified T cells as described herein for the treatment of cancer, and a method of treatment of cancer may comprise administering a population of modified T cells as described herein to an individual in need thereof.

The population of modified T cells may be autologous i.e. the modified T cells were originally obtained from the same individual to whom they are subsequently administered (i.e. the donor and recipient individual are the same). A suitable population of modified T cells for administration to the individual may be produced by a method comprising providing an initial population of T cells obtained from the individual, modifying the T cells to express a cAMP PDE or fragment thereof and an antigen receptor which binds specifically to cancer cells in the individual, and culturing the modified T cells.

The population of modified T cells may be allogeneic i.e. the modified T cells were originally obtained from a different individual to the individual to whom they are subsequently administered (i.e. the donor and recipient individual are different). The donor and recipient individuals may be HLA matched to avoid GVHD and other undesirable immune effects. A suitable population of modified T cells for administration to a recipient individual may be produced by a method comprising providing an initial population of T cells obtained from a donor individual, modifying the T cells to express a CoStAR which binds specifically to cancer cells in the recipient individual, and culturing the modified T cells.

Following administration of the modified T cells, the recipient individual may exhibit a T cell mediated immune response against cancer cells in the recipient individual. This may have a beneficial effect on the cancer condition in the individual.

Cancer conditions may be characterised by the abnormal proliferation of malignant cancer cells and may include leukaemias, such as AML, CML, ALL and CLL, lymphomas, such as Hodgkin lymphoma, non-Hodgkin lymphoma and multiple myeloma, and solid cancers such as sarcomas, skin cancer, melanoma, bladder cancer, brain cancer, breast cancer, uterus cancer, ovary cancer, prostate cancer, lung cancer, colorectal cancer, cervical cancer, liver cancer, head and neck cancer, oesophageal cancer, pancreas cancer, renal cancer, adrenal cancer, stomach cancer, testicular cancer, cancer of the gall bladder and biliary tracts, thyroid cancer, thymus cancer, cancer of bone, and cerebral cancer, as well as cancer of unknown primary (CUP).

Cancer cells within an individual may be immunologically distinct from normal somatic cells in the individual (i.e. the cancerous tumor may be immunogenic). For example, the cancer cells may be capable of eliciting a systemic immune response in the individual against one or more antigens expressed by the cancer cells. The tumor antigens that elicit the immune response may be specific to cancer cells or may be shared by one or more normal cells in the individual.

An individual suitable for treatment as described above may be a mammal, such as a rodent (e.g. a guinea pig, a hamster, a rat, a mouse), murine (e.g. a mouse), canine (e.g. a dog), feline (e.g. a cat), equine (e.g. a horse), a primate, simian (e.g. a monkey or ape), a monkey (e.g. marmoset, baboon), an ape (e.g. gorilla, chimpanzee, orang-utan, gibbon), or a human.

In preferred embodiments, the individual is a human. In other preferred embodiments, non-human mammals, especially mammals that are conventionally used as models for demonstrating therapeutic efficacy in humans (e.g. murine, primate, porcine, canine, or rabbit animals) may be employed.

Method of Treatment

Cells, including T and NK cells, expressing CoStARs can either be created ex vivo either from a patient's own peripheral blood (autologous), or in the setting of a haematopoietic stem cell transplant from donor peripheral blood (allogenic), or peripheral blood from an unconnected donor (allogenic). In some embodiments, T-cells or NK cells can be derived from ex-vivo differentiation of inducible progenitor cells or embryonic progenitor cells to T-cells or NK cells. In these instances, T-cells expressing a CoStAR and, optionally, a CAR and/or TCR, are generated by introducing DNA or RNA coding for the CoStAR and, optionally, a CAR and/or TCR, by one of many means including transduction with a viral vector, transfection with DNA or RNA.

T or NK cells expressing a CoStAR and, optionally, expressing a TCR and/or CAR can be used for the treatment of haematological cancers or solid tumors.

In some embodiments, a method of cell therapy comprising identifying a subject in need of tumor infiltrating lymphocyte ("TIL") cell therapy and administering to the subject a TIL cell therapy is provided. The TIL cell therapy comprises a fusion protein as provided herein (such as a CEA CoStAR and/or fusion protein or a MSLN CoStAR and/or fusion protein), which can comprise a binding domain specific (e.g, specific for CEA CoStAR and/or fusion protein or a MSLN CoStAR and/or fusion portein) linked to a transmembrane domain that is linked to a CD28 signaling domain (for MSLN, or an ICOS domain for CEA) that is linked to a CD40 signaling domain.

The term "therapeutically effective amount" refers to an amount of a CoStAR or composition comprising a CoStAR as disclosed herein, effective to "treat" a disease or disorder in an individual. In the case of cancer, the therapeutically effective amount of a CoStAR or composition comprising a CoStAR as disclosed herein can reduce the number of cancer cells; reduce the tumor size or weight; inhibit (i.e., slow to some extent and preferably stop) cancer cell infiltration into peripheral organs; inhibit (i.e., slow to some extent and preferably stop) tumor metastasis; inhibit, to some extent, tumor growth; and/or relieve to some extent one or more of the symptoms associated with the cancer. To the extent a CoStAR or composition comprising a CoStAR as disclosed herein can prevent growth and/or kill existing cancer cells, it can be cytostatic and/or cytotoxic. In some embodiments, the therapeutically effective amount is a growth inhibitory amount. In some embodiments, the therapeutically effective amount is an amount that improves progression free survival of a patient. In the case of infectious disease, such as viral infection, the therapeutically effective amount of a CoStAR or composition comprising a CoStAR as disclosed herein can reduce the number of cells infected by the pathogen; reduce the production or release of pathogen-derived antigens; inhibit (i.e., slow to some extent and preferably stop) spread of the pathogen to uninfected cells; and/or relieve to some extent one or more symptoms associated with the infection. In some embodiments, the therapeutically effective amount is an amount that extends the survival of a patient.

Cells, including T and NK cells, expressing CoStARs for use in the methods of the present may either be created ex vivo either from a patient's own peripheral blood (autologous), or in the setting of a haematopoietic stem cell transplant from donor peripheral blood (allogenic), or peripheral blood from an unconnected donor (allogenic). Alternatively, T-cells or NK cells may be derived from ex-vivo differentiation of inducible progenitor cells or embryonic progenitor cells to T-cells or NK cells. In these instances, T-cells expressing a CoStAR and, optionally, a CAR and/or TCR, are generated by introducing DNA or RNA coding for the CoStAR and, optionally, a CAR and/or TCR, by one of many means including transduction with a viral vector, transfection with DNA or RNA.

T or NK cells expressing a CoStAR as disclosed herein and, optionally, expressing a TCR and/or CAR may be used for the treatment of haematological cancers or solid tumors.

A method for the treatment of disease relates to the therapeutic use of a vector or cell, including a T or NK cell, as disclosed herein. In this respect, the vector, or T or NK cell may be administered to a subject having an existing disease or condition in order to lessen, reduce or improve at least one symptom associated with the disease and/or to slow down, reduce or block the progression of the disease. In some embodiments, the method can cause or promote T-cell mediated killing of cancer cells. In some embodiments, the vector, or T or NK cell can be administered to a patient with one or more additional therapeutic agents. The one or more additional therapeutic agents can be co-administered to the patient. By "co-administering" is meant administering one or more additional therapeutic agents and the vector, or T or NK cell as provided herein sufficiently close in time such that the vector, or T or NK cell can enhance the effect of one or more additional therapeutic agents, or vice versa. In this regard, the vectors or cells can be administered first and the one or more additional therapeutic agents can be administered second, or vice versa. Alternatively, the vectors or cells and the one or more additional therapeutic agents can be administered simultaneously. One co-administered therapeutic agent that may be useful is IL-2, as this is currently used in existing cell therapies to boost the activity of administered cells. However, IL-2 treatment is associated with toxicity and tolerability issues.

As mentioned, for administration to a patient, the CoStAR effector cells can be allogeneic or autologous to the patient. In some embodiments, allogeneic cells are further genetically modified, for example by gene editing, so as to minimize or prevent GVHD and/or a patient's immune response against the CoStAR cells.

The CoStAR effector cells are used to treat cancers and neoplastic diseases associated with a target antigen. Cancers and neoplastic diseases that may be treated using any of the methods described herein include tumors that are not vascularized, or not yet substantially vascularized, as well as vascularized tumors. The cancers may comprise non-solid tumors (such as hematological tumors, for example, leukemias and lymphomas) or may comprise solid tumors. Types of cancers to be treated with the CoStAR effector cells of the include, but are not limited to, carcinoma, blastoma, and sarcoma, and certain leukemia or lymphoid malignancies, benign and malignant tumors, and malignancies e.g., sarcomas, carcinomas, and melanomas. Adult tumors/cancers and pediatric tumors/cancers are also included.

Hematologic cancers are cancers of the blood or bone marrow. Examples of hematological (or hematogenous) cancers include leukemias, including acute leukemias (such as acute lymphocytic leukemia, acute myelocytic leukemia, acute myelogenous leukemia and myeloblastic, promyelocytic, myelomonocytic, monocytic and erythroleukemia), chronic leukemias (such as chronic myelocytic (granulocytic) leukemia, chronic myelogenous leukemia, and chronic lymphocytic leukemia), polycythemia vera, lymphoma, Hodgkin's disease, non-Hodgkin's lymphoma (indolent and high grade forms), multiple myeloma, plasmacytoma, Waldenstrom's macroglobulinemia, heavy chain disease, myelodysplastic syndrome, hairy cell leukemia and myelodysplasia.

Solid tumors are abnormal masses of tissue that usually do not contain cysts or liquid areas. Solid tumors can be benign or malignant. Different types of solid tumors are named for the type of cells that form them (such as sarcomas, carcinomas, and lymphomas). Examples of solid tumors, such as sarcomas and carcinomas, include adrenocortical carcinoma, cholangiocarcinoma, fibrosarcoma, myxosarcoma, liposarcoma, chondrosarcoma, osteosarcoma, and other sarcomas, synovioma, mesothelioma, Ewing's tumor, leiomyosarcoma, rhabdomyosarcoma, colon carcinoma, stomach cancer, lymphoid malignancy, pancreatic cancer, breast cancer, lung cancers, ovarian cancer, prostate cancer, hepatocellular carcinoma, squamous cell carcinoma, basal cell carcinoma, adenocarcinoma, sweat gland carcinoma, thyroid cancer (e.g., medullary thyroid carcinoma and papillary thyroid carcinoma), pheochromocytomas sebaceous gland carcinoma, papillary carcinoma, papillary adenocarcinomas, medullary carcinoma, bronchogenic carcinoma, renal cell carcinoma, hepatoma, bile duct carcinoma, choriocarcinoma, Wilms' tumor, cervical cancer (e.g., cervical carcinoma and pre-invasive cervical dysplasia), colorectal cancer, cancer of the anus, anal canal, or anorectum, vaginal cancer, cancer of the vulva (e.g., squamous cell carcinoma, intraepithelial carcinoma, adenocarcinoma, and fibrosarcoma), penile cancer, oropharyngeal cancer, esophageal cancer, head cancers (e.g., squamous cell carcinoma), neck cancers (e.g., squamous cell carcinoma), testicular cancer (e.g., seminoma, teratoma, embryonal carcinoma, teratocarcinoma, choriocarcinoma, sarcoma, Leydig cell tumor, fibroma, fibroadenoma, adenomatoid tumors, and lipoma), bladder carcinoma, kidney cancer, melanoma, cancer of the uterus (e.g., endometrial carcinoma), urothelial cancers (e.g., squamous cell carcinoma, transitional cell carcinoma, adenocarcinoma, ureter cancer, and urinary bladder cancer), and CNS tumors (such as a glioma (such as brainstem glioma and mixed gliomas), glioblastoma (also known as glioblastoma multiforme) astrocytoma, CNS lymphoma, germinoma, medulloblastoma, Schwannoma craniopharyogioma, ependymoma, pinealoma, hemangioblastoma, acoustic neuroma, oligodendroglioma, menangioma, neuroblastoma, retinoblastoma and brain metastases).

When "an immunologically effective amount," "an anti-tumor effective amount," "a tumor-inhibiting effective amount," or "therapeutic amount" is indicated, the precise amount of the compositions to be administered can be determined by a physician with consideration of individual differences in age, weight, tumor size, extent of infection or metastasis, and condition of the patient (subject). It can generally be stated that a pharmaceutical composition comprising the T cells described herein may be administered at a dosage of $10^4$ to $10^9$ cells/kg body weight, in some instances $10^5$ to $10^6$ cells/kg body weight, including all integer values within those ranges. T cell compositions may also be administered multiple times at these dosages. The cells can be administered by using infusion techniques that are commonly known in immunotherapy (see, e.g., Rosenberg et al., New Eng. J. of Med. 319:1676, 198

In some embodiments, additional aspects of the method are shown in part or whole in FIGS. 83 and 83.

In some embodiments, the dosage can be $1 \times 10^9$ CoStAR-positive (CoStAR+) viable T cells (±20% target dose). In some embodiments, the dosage can be, or be increased to $5 \times 10^8$ CoStAR+ viable T cells (±20% target dose). In some embodiments, the dosage can be, or be increased to $3 \times 10^9$ CoStAR+ viable T cells (±20% target dose). In some embodiments, the dosage can be, or be increased to, $6 \times 10^9$ CoStAR+ viable T cells (±20% target dose). In some embodiments, the dosage is at least any one of the preceding values. In some embodiments, the dosage is between any two of the preceding values.

Combination Therapies

A CoStAR-expressing cell described herein may be used in combination with other known agents and therapies. Administered "in combination", as used herein, means that two (or more) different treatments are delivered to the subject during the course of the subject's affliction with the disorder, e.g., the two or more treatments are delivered after the subject has been diagnosed with the disorder and before the disorder has been cured or eliminated or treatment has ceased for other reasons. In some embodiments, the delivery of one treatment is still occurring when the delivery of the second begins, so that there is overlap in terms of administration. This is sometimes referred to herein as "simultaneous" or "concurrent delivery". In other embodiments, the delivery of one treatment ends before the delivery of the other treatment begins. In some embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In some embodiments, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered.

A CoStAR-expressing cell described herein and the at least one additional therapeutic agent can be administered simultaneously, in the same or in separate compositions, or sequentially. For sequential administration, the CAR-expressing cell described herein can be administered first, and the additional agent can be administered second, or the order of administration can be reversed.

The CoStAR therapy and/or other therapeutic agents, procedures or modalities can be administered during periods of active disorder, or during a period of remission or less active disease. The CoStAR therapy can be administered before the other treatment, concurrently with the treatment, post-treatment, or during remission of the disorder.

When administered in combination, the therapy and the additional agent (e.g., second or third agent), or all, can be administered in an amount or dose that is higher, lower or the same than the amount or dosage of each agent used individually, e.g., as a monotherapy. In some embodiments, the administered amount or dosage of the CoStAR therapy, the additional agent (e.g., second or third agent), or all, is lower (e.g., at least 20%, at least 30%, at least 40%, or at least 50%) than the amount or dosage of each agent used individually, e.g., as a monotherapy. In other embodiments, the amount or dosage of the CoStAR therapy, the additional agent (e.g., second or third agent), or all, that results in a desired effect (e.g., treatment of cancer) is lower (e.g., at least 20%, at least 30%, at least 40%, or at least 50% lower) than the amount or dosage of each agent used individually, e.g., as a monotherapy, required to achieve the same therapeutic effect.

In further aspects, a CoStAR-expressing cell described herein may be used in a treatment regimen in combination with surgery, chemotherapy, radiation, immunosuppressive agents, such as cyclosporin, azathioprine, methotrexate, mycophenolate, and FK506, antibodies, or other immunoablative agents such as CAMPATH, anti-CD3 antibodies or other antibody therapies, cytoxin, fludarabine, cyclosporin, FK506, rapamycin, mycophenolic acid, steroids, FR901228, cytokines, and irradiation, peptide vaccine, such as that described in Izumoto et al. 2008 J Neurosurg 108:963-971.

In some embodiments, compounds as disclosed herein are combined with other therapeutic agents, such as other anticancer agents, anti-allergic agents, anti-nausea agents (or anti-emetics), pain relievers, cytoprotective agents, and combinations thereof.

In one embodiment, a CoStAR-expressing cell described herein can be used in combination with a chemotherapeutic agent. Exemplary chemotherapeutic agents include an anthracycline (e.g., doxorubicin (e.g., liposomal doxorubicin)), a vinca alkaloid (e.g., vinblastine, vincristine, vindesine, vinorelbine), an alkylating agent (e.g., cyclophosphamide, decarbazine, melphalan, Ifosfamide, temozolomide), an immune cell antibody (e.g., alemtuzamab, gemtuzumab, rituximab, ofatumumab, tositumomab, brentuximab), an antimetabolite (including, e.g., folic acid antagonists, pyrimidine analogs, purine analogs and adenosine deaminase inhibitors (e.g., fludarabine)), an mTOR inhibitor, a TNFR glucocorticoid induced TNFR related protein (GITR) agonist, a proteasome inhibitor (e.g., aclacinomycin A, gliotoxin or bortezomib), an immunomodulator such as thalidomide or a thalidomide derivative (e.g., lenalidomide).

General Chemotherapeutic agents considered for use in combination therapies include busulfan (Myleran®), busulfan injection (Busulfex®), cladribine (Leustatin®), cyclophosphamide (Cytoxan® or Neosar®), cytarabine, cytosine arabinoside (Cytosar-U®), cytarabine liposome injection (DepoCyt®), daunorubicin hydrochloride (Cerubidine®), daunorubicin citrate liposome injection (DaunoXome®), dexamethasone, doxorubicin hydrochloride (Adriamycin®, Rubex®), etoposide (Vepesid®), fludarabine phosphate (Fludara®), hydroxyurea (Hydrea®), Idarubicin (Idamycin®), mitoxantrone (Novantrone®), Gemtuzumab Ozogamicin (Mylotarg®).

In embodiments, general chemotherapeutic agents considered for use in combination therapies include anastrozole (Arimidex®), bicalutamide (Casodex®), bleomycin sulfate (Blenoxane®), busulfan (Myleran®), busulfan injection (Busulfex®), capecitabine (Xeloda®), N4-pentoxycarbonyl-5-deoxy-5-fluorocytidine, carboplatin (Paraplatin®), carmustine (BiCNU®), chlorambucil (Leukeran®), cisplatin (Platinol®), cladribine (Leustatin®), cyclophosphamide (Cytoxan® or Neosar®), cytarabine, cytosine arabinoside (Cytosar-U®), cytarabine liposome injection (DepoCyt®), dacarbazine (DTIC-Dome®), dactinomycin (Actinomycin D, Cosmegan), daunorubicin hydrochloride (Cerubidine®), daunorubicin citrate liposome injection (DaunoXome®), dexamethasone, docetaxel (Taxotere®), doxorubicin hydrochloride (Adriamycin®, Rubex®), etoposide (Vepesid®), fludarabine phosphate (Fludara®), 5-fluorouracil (Adrucil®, Efudex®), flutamide (Eulexin®), tezacitibine, Gemcitabine (difluorodeoxycitidine), hydroxyurea (Hydrea®), Idarubicin (Idamycin®), ifosfamide (IFEX®), irinotecan (Camptosar®), L-asparaginase (ELSPAR®), leucovorin calcium, melphalan (Alkeran®), 6-mercaptopurine (Purinethol®), methotrexate (Folex®), mitoxantrone (Novantrone®), mylotarg, paclitaxel (Taxol®), phoenix (Yttrium90/MX-DTPA), pentostatin, polifeprosan 20 with carmustine implant (Gliadel®), tamoxifen citrate (Nolvadex®), teniposide (Vumon®), 6-thioguanine, thiotepa, tirapazamine (Tirazone®), topotecan hydrochloride for injection (Hycamptin®), vinblastine (Velban®), vincristine (Oncovin®), and vinorelbine (Navelbine®).

Treatments can be evaluated, for example, by tumor regression, tumor weight or size shrinkage, time to progression, duration of survival, progression free survival, overall response rate, duration of response, quality of life, protein expression and/or activity. Approaches to determining efficacy of the therapy can be employed, including for example, measurement of response through radiological imaging.

In some embodiments, any one of the sequences used or provided in Table 7 and/or FIGS. 83 and 84 can be employed in the methods provided herein. In FIGS. 83 and 84, the underlined bolded regions comprise CDRs. In some embodiments, the antigen binding domain of the fusion protein can target CEA. In some embodiments, the antigen binding domain of the fusion protein can target CEA. In some embodiments the antigen binding domain of the fusion protein can target MSLN. In some embodiments, this includes some part of SEQ ID NO: 12 and/or parts of SEQ ID NO: 186-191, and/or variants thereof. In some embodiments, the fusion protein or CoSTaR comprises the MSLN construct components provided in FIG. 84 (all or in part or variants thereof). In some embodiments, this includes SEQ ID Nos: 192, 218, 228, 246, 264, or 282 (all or in part or variants thereof).

Sequences

The following sequences include complete CoStARs and CoStAR components and are non-limiting. Components include signal peptides (SP), binding domains (BD), linkers, spacers and transmembrane domains (STM), a CD28 transmembrane fragment without extracellular or intracellular sequences (STM-CD28TM), intracellular signal domains (SD) and CD40 domains and motifs. Whereas SEQ ID NOS:42-247 or 196-335, 362-363, 369-420, and 514 comprise CoStARs with N-terminal signal peptides, it will be understood that the N-terminal signal peptides are removed from a mature CoStAR. Further, is will be understood that a mature CoStAR may may lack 1, 2, 3, 4, 5, 6, 7, 8, 9, or 10 or more amino acids at the N-terminal (i.e., counted from the C-terminal end of the signal peptide). Component locations within whole proteins can be confirmed from exemplary sequences presented herein and from GenBank and other sources. The constructs and components are illustrative as to precise sizes and extents and components can be from more than one source. Where there is more than one intracellular signaling domain or signaling fragment, the multiple domains can be in any order. It will be understood that whereas certain proteins may comprise N-terminal signal peptides when expressed, those signal peptides are cleaved and may be imprecisely cleaved when the proteins are expressed, and that the resulting proteins from which signal peptides are removed comprise binding domains having variation of up to about five amino acids in the location of the N-terminal amino acid.

TABLE 7

Amino Acid Sequences

| ID No | Component | Sequence | | | |
|---|---|---|---|---|---|
| 1 | SP-OSM | MGVLLTQRTL | LSLVLALLFP | SMASM | |
| 2 | SP-CD8α | MALPVTALLL | PLALLLHAAR | P | |
| 3 | SP-CD2 | MSFPCKFVAS | FLLIFNVSSK | GAVS | |
| 4 | SP-IL2 | MYRMQLLSCI | ALSLALVTNS | | |
| 5 | SP-GM-CSF | MWLQSLLLLG | TVACSIS | | |
| 6 | SP-hIgGk-VIII | MEAPAQLLFL | LLLWLPDTTR | | |
| 7 | SP-PD1 | MGVLLTQRTL | LSLVLALLFP | SMASM | |
| 8 | SP-TIGIT | MQIPQAPWPV | VWAVLQLGWR | PGW | |
| 9 | BD1-MOV | QVQLQQSGAE | LVKPGASVKI | SCKASGYSFT | GYFMNWVKQS HGKSLEWIGR |
| | | IHPYDGDTFY | NQNFKDKATL | TVDKSSNTAH | MELLSLTSED FAVYYCTRYD |
| | | GSRAMDYWGQ | GTTVTVSSGG | GGSGGGGSGG | GGSDIELTQS PASLAVSLGQ |
| | | RAIISCKASQ | SVSFAGTSLM | HWYHQKPGQQ | PKLLIYRASN LEAGVPTRFS |
| | | GSGSKTDFTL | NIHPVEEEDA | ATYYCQQSRE | YPYTFGGGTK LEIK |
| 10 | MFE23 | QVKLQQSGAE | LVRSGTSVKL | SCTASGFNIK | DSYMHWLRQG PEQGLEWIGW |
| | | IDPENGDTEY | APKFQGKATF | TTDTSSNTAY | LQLSSLTSED TAVYYCNEGT |
| | | PTGPYYFDYW | GQGTTVTVSS | GGGGSGGGGS | GGGGSENVLT QSPAIMSASP |
| | | GEKVTITCSA | SSSVSYMHWF | QQKPGTSPKL | WIYSTSNLAS GVPARFSGSG |
| | | SGTSYSLTIS | RMEAEDAATY | YCQQRSSYPL | TFGAGTKLEL KR |
| 11 | MFE23 (K > Q) | QVQLQQSGAE | LVRSGTSVKL | SCTASGFNIK | DSYMHWLRQG PEQGLEWIGW |
| | | IDPENGDTEY | APKFQGKATF | TTDTSSNTAY | LQLSSLTSED TAVYYCNEGT |
| | | PTGPYYFDYW | GQGTTVTVSS | GGGGSGGGGS | GGGGSENVLT QSPAIMSASP |
| | | GEKVTITCSA | SSSVSYMHWF | QQKPGTSPKL | WIYSTSNLAS GVPARFSGSG |
| | | SGTSYSLTIS | RMEAEDAATY | YCQQRSSYPL | TFGAGTKLEL KR |
| 12 | hMFE23 | QVKLEQSGAE | VVKPGASVKL | SCKASGFNIK | DSYMHWLRQG PGQRLEWIGW |
| | | IDPENGDTEY | APKFQGKATF | TTDTSANTAY | LGLSSLRPED TAVYYCNEGT |
| | | PTGPYYFDYW | GQGTLVTVSS | GGGGSGGGGS | GGGGSENVLT QSPSSMSASV |
| | | GDRVNIACSA | SSSVSYMHWF | QQKPGKSPKL | WIYSTSNLAS GVPSRFSGSG |
| | | SGTDYSLTIS | SMQPEDAATY | YCQQRSSYPL | TFGGGTKLEI K |
| 13 | CEA6 | QVQLVQSGAE | VKKPGSSVKV | SCKASGGTFS | NSPINWLRQA PGQGLEWMGS |
| | | IIPSFGTANY | AQKFQGRLTI | TADESTSTAY | MELSSLRSED TAVYYCAGRS |
| | | HNYELYYYM | DVWGQGTMVT | VSSGGGGSGG | GGSGGGGSDI QMTQSPSTLS |
| | | ASIGDRVTIT | CRASEGIYHW | LAWYQQKPGK | APKLLIYKAS SLASGAPSRF |
| | | SGSGSGTDFT | LTISSLQPDD | FATYYCQQYS | NYPLTFGGGT KLEIKR |
| 14 | BW431/26 | QLQESGPGLV | RPSQTLSLTC | TVSGFTISSG | YSWHWVRQPP GRGLEWIGYI |
| | | QYSGITNYNP | SLKSRVTMLV | DTSKNQFSLR | LSSVTAADTA VYYCAREDYD |
| | | YHWYFDVWGQ | GSLVTVSSGG | GGSGGGGSGG | GGSGVHSDIQ MTQSPSSLSA |
| | | SVGDRVTITC | STSSSVSYMH | WYQQKPGKAP | KLLIYSTSNL ASGVPSRFSG |
| | | SGSGTDFTFT | ISSLQPEDIA | TYYCHQWSSY | PTFGQGTKVE IKR |
| 15 | HuT84.66 (M5A) | EVQLVESGGG | LVQPGGSLRL | SCAASGFNIK | DTYMHWVRQA PGKGLEWVAR |
| | | IDPANGNSKY | ADSVKGRFTI | SADTSKNTAY | LQMNSLRAED TAVYYCAPFG |
| | | YYVSDYAMAY | WGQGTLVTVS | SGGGGSGGGG | SGGGGSDIQL TQSPSSLSAS |
| | | VGDRVTITCR | AGESVDIFGV | GFLHWYQQKP | GKAPKLLIYR ASNLESGVPS |
| | | RFSGSGSRTD | FTLTISSLQP | EDFATYYCQQ | TNEDPYTFGQ GTKVEIK |
| 16 | BD1-PD1 | RPGWFLDSPD | RPWNPPTFSP | ALLVVTEGDN | ATFTCSFSNT SESFVLNWYR |
| | | MSPSNQTDKL | AAFPEDRSQP | GQDCRFRVTQ | LPNGRDFHMS VVRARRNDSG |
| | | TYLCGAISLA | PKAQIKESLR | AELRVTERRA | EVPTAH |

TABLE 7-continued

Amino Acid Sequences

| ID No | Component | Sequence |
|---|---|---|
| 17 | BD1-TIGIT | MMTGTIETTG NISAEKGGSI ILQCHLSSTT AQVTQVNWEQ QDQLLAICNA DLGWHISPSF KDRVAPGPGL GLTLQSLTVN DTGEYFCIYH TYPDGTYTGR IFLEVLESSV AEHGARFQIP |
| 18 | 3XA2Xgsg | AAAGSGGSG |
| 19 | STM-spCD28 | ILVKQSPMLV AYDNAVNLSC KYSYNLFSRE FRASLHKGLD SAVEVCVVYG NYSQQLQVYS KTGFNCDGKL GNESVTFYLQ NLYVNQTDIY FCKIEVMYPP PYLDNEKSNG TIIHVKGKHL CPSPLFPGPS KPFWVLVVVG GVLACYSLLV TVAFIIFWV |
| 20 | STM-spCD8 | FVPVFLPAKP TTTPAPRPPT PAPTIASQPL SLRPEACRPA AGGAVHTRGL DFACDIYIWA PLAGTCGVLL LSLVITLYCN HRN |
| 21 | STM-CD28TM | FWVLVVVGGV LACYSLLVTV AFIIFWV |
| 22 | STM-spCD28TM | CPSPLFPGPS KPFWVLVVVG GVLACYSLLV TVAFIIFWV |
| 23 | STM-CD28IIH (trun) | IIHVKGKHLC PSPLFPGPSK PFWVLVVVGG VLACYSLLVT VAFIIFWV |
| 24 | STM-spIG4 | ESKYGPPCPS CPAPEFLGGP SVFLFPPKPK DTLMISRTPE VTCVVVDVSQ EDPEVQFNWY VDGVEVHNAK TKPREEQFNS TYRVVSVLTV LHQDWLNGKE YKCKVSNKGL PSSIEKTISK AKGQPREPQV YTLPPSQEEM TKNQVSLTCL VKGFYPSDIA VEWESNGQPE NNYKTTPPVL DSDGSFFLYS RLTVDKSRWQ EGNVFSCSVM HEALHNHYTQ KSLSLSLGKM FWVLVVVGGV LACYSLLVTV AFIIFWV |
| 25 | Sig-CD28 | RSKRSRLLHS DYMNMTPRRP GPTRKHYQPY APPRDFAAYR S |
| 26 | Sig-CD137 | RFSVVKRGRK KLLYIFKQPF MRPVQTTQEE DGCSCRFPEE EEGGCE |
| 27 | Sig-CD134 | RRDQRLPPDA HKPPGGGSFR TPIQEEQADA HSTLAKI |
| 28 | Sig-CD2 | KRKKQRSRRN DEELETRAHR VATEERGRKP HQIPASTPQN PATSQHPPPP PGHRSQAPSH RPPPPGHRVQ HQPQKRPPAP SGTQVHQQKG PPLPRPRVQP KPPHGAAENS LSPSSN |
| 29 | Sig GITR | QLGLHIWQLR SQCMWPRETQ LLLEVPPSTE DARSCQFPEE ERGERSAEEK GRLGDLWV |
| 30 | Sig-CD29 | KLLMIIHDRR EFAKFEKEKM NAKWDTGENP IYKSAVTTVV NPKYEGK |
| 31 | Sig-CD150 | RRRGKTNHYQ TTVEKKSLTI YAQVQKPGPL QKKLDSFPAQ DPCTTIYVAA TEPVPESVQE TNSITVYASV TLPES |
| 32 | CD40 | KKVAKKPTNK APHPKQEPQE INFPDDLPGS NTAAPVQETL HGCQPVTQED GKESRISVQE RQ |
| 33 | CD40_tandem | AKKPTNKAPH PKQEPQEINF PDDLPGSNTA APVQETLHGC QPVTQEDGKE SRISVQERQK KVAKKPTNKA PHPKQEPQEI NFPDDLPGSN TAAPVQETLH GCQPVTQEDG KESRISVQER QKKVA |
| 34 | CD40_P227A | KKVAKKPTNK AAHPKQEPQE INFPDDLPGS NTAAPVQETL HGCQPVTQED GKESRISVQE RQ |
| 35 | SH3_motif | KPTNKAPH |
| 36 | TRAF2_motif1 | PKQE |
| 37 | TRAF2_motif2 | PVQE |
| 38 | TRAF2_motif3 | SVQE |
| 39 | TRAF6_motif | QEPQEINFP |

TABLE 7-continued

Amino Acid Sequences

| ID No | Component | Sequence |
|---|---|---|
| 40 | PKA_motif 1 | KKPTNKA |
| 41 | PKA_motif 2 | SRISVQE |
| 42 | OSM_MFE23 _spCD28 _CD28_CD4 0 CTP194 | MGVLLTQRTL LSLVLALLFP SMASMQVKLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGSGILVK QSPMLVAYDN AVNLSCKYSY NLFSREFRAS LHKGLDSAVE VCVVYGNYSQ QLQVYSKTGF NCDGKLGNES VTFYLQNLYV NQTDIYFCKI EVMYPPPYLD NEKSNGTIIH VKGKHLCPSP LFPGPSKPFW VLVVVGGVLA CYSLLVTVAF IIFWVRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 43 | CD8α_MFE2 3 _spCD28 _CD28_CD4 0 CTP255 | MALPVTALLL PLALLLHAAR PQVKLQQSGA ELVRSGTSVK LSCTASGFNI KDSYMHWLRQ GPEQGLEWIG WIDPENGDTE YAPKFQGKAT FTTDTSSNTA YLQLSSLTSE DTAVYYCNEG TPTGPYYFDY WGQGTTVTVS SGGGGSGGGG SGGGGSENVL TQSPAIMSAS PGEKVTITCS ASSSVSYMHW FQQKPGTSPK LWIYSTSNLA SGVPARFSGS GSGTSYSLTI SRMEAEDAAT YYCQQRSSYP LTFGAGTKLE LKRAAAGSGG SGILVKQSPM LVAYDNAVNL SCKYSYNLFS REFRASLHKG LDSAVEVCVV YGNYSQQLQV YSKTGFNCDG KLGNESVTFY LQNLYVNQTD IYFCKIEVMY PPPYLDNEKS NGTIIHVKGK HLCPSPLFPG PSKPFWVLVV VGGVLACYSL LVTVAFIIFW VRSKRSLLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |
| 44 | CD2_MFE23 _spCD28 _CD28_CD4 0 CTP256 | MSFPCKFVAS FLLIFNVSSK GAVSQVKLQQ SGAELVRSGT SVKLSCTASG FNIKDSYMHW LRQGPEQGLE WIGWIDPENG DTEYAPKFQG KATFTTDTSS NTAYLQLSSL TSEDTAVYYC NEGTPTGPYY FDYWGQGTTV TVSSGGGGSG GGGSGGGGSE NVLTQSPAIM SASPGEKVTI TCSASSSVSY MHWFQQKPGT SPKLWIYSTS NLASGVPARF SGSGSGTSYS LTISRMEAED AATYYCQQRS SYPLTFGAGT KLELKRAAAG SGGSGILVKQ SPMLVAYDNA VNLSCKYSYN LFSREFRASL HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 45 | IL2_MFE23 _spCD28 _CD28_CD4 0 CTP257 | MYRMQLLSCI ALSLALVTNS QVKLQQSGAE LVRSGTSVKL SCTASGFNIK DSYMHWLRQG PEQGLEWIGW IDPENGDTEY APKFQGKATF TTDTSSNTAY LQLSSLTSED TAVYYCNEGT PTGPYYFDYW GQGTTVTVSS GGGGSGGGGS GGGGSENVLT QSPAIMSASP GEKVTITCSA SSSVSYMHWF QQKPGTSPKL WIYSTSNLAS GVPARFSGSG SGTSYSLTIS RMEAEDAATY YCQQRSSYPL TFGAGTKLEL KRAAAGSGGS GILVKQSPML VAYDNAVNLS CKYSYNLFSR EFRASLHKGL DSAVEVCVVY GNYSQQLQVY SKTGFNCDGK LGNESVTFYL QNLYVNQTDI YFCKIEVMYP PPYLDNEKSN GTIIHVKGKH LCPSPLFPGP SKPFWVLVVV GGVLACYSLL VTVAFIIFWV RSKRSLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |
| 46 | GM-CSF_MFE23 _spCD28 _CD28_CD4 0 CTP258 | MWLQSLLLLG TVACSISQVK LQQSGAELVR SGTSVKLSCT ASGFNIKDSY MHWLRQGPEQ GLEWIGWIDP ENGDTEYAPK FQGKATFTTD TSSNTAYLQL SSLTSEDTAV YYCNEGTPTG PYYFDYWGQG TTVTVSSGGG GSGGGGSGGG GSENVLTQSP AIMSASPGEK VTITCSASSS VSYMHWFQQK PGTSPKLWIY STSNLASGVP ARFSGSGSGT SYSLTISRME AEDAATYYCQ QRSSYPLTFG AGTKLELKRA AAGSGGSGIL VKQSPMLVAY DNAVNLSCKY SYNLFSREFR ASLHKGLDSA VEVCVVYGNY SQQLQVYSKT GFNCDGKLGN ESVTFYLQNL YVNQTDIYFC KIEVMYPPPY LDNEKSNGTI IHVKGKHLCP SPLFPGPSKP FWVLVVVGGV LACYSLLVTV AFIIFWVRSK RSLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |
| 47 | hIgGk-VIII_MFE2 3 _spCD28 _CD28_CD4 0 CTP259 | MEAPAQLLFL LLLWLPDTTR QVKLQQSGAE LVRSGTSVKL SCTASGFNIK DSYMHWLRQG PEQGLEWIGW IDPENGDTEY APKFQGKATF TTDTSSNTAY LQLSSLTSED TAVYYCNEGT PTGPYYFDYW GQGTTVTVSS GGGGSENVLT QSPAIMSASP GEKVTITCSA SSSVSYMHWF QQKPGTSPKL WIYSTSNLAS GVPARFSGSG SGTSYSLTIS RMEAEDAATY YCQQRSSYPL TFGAGTKLEL KRAAAGSGGS GILVKQSPML VAYDNAVNLS CKYSYNLFSR EFRASLHKGL DSAVEVCVVY GNYSQQLQVY SKTGFNCDGK LGNESVTFYL QNLYVNQTDI YFCKIEVMYP PYLDNEKSN GTIIHVKGKH LCPSPLFPGP |

TABLE 7-continued

Amino Acid Sequences

| ID No | Component | Sequence |
|---|---|---|
| | | SKPFWVLVVV GGVLACYSLL VTVAFIIFWV RSKRSRLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |
| 48 | OSM_MFE23 _spCD8 _CD28_CD4 0 CTP190 | MGVLLTQRTL LSLVLALLFP SMASMQVKLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGGSGFVPV FLPAKPTTTP APRPPTPAPT IASQPLSLRP EACRPAAGGA VHTRGLDFAC DIYIWAPLAG TCGVLLLSLV ITLYCNHRNR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 49 | CD8a_MFE2 3 _spCD8 _CD28_CD4 0 | MALPVTALLL PLALLLHAAR PQVKLQQSGA ELVRSGTSVK LSCTASGFNI KDSYMHWLRQ GPEQGLEWIG WIDPENGDTE YAPKFQGKAT FTTDTSSNTA YLQLSSLTSE DTAVYYCNEG TPTGPYYFDY WGQGTTVTVS SGGGGSGGGG SGGGGSENVL TQSPAIMSAS PGEKVTITCS ASSSVSYMHW FQQKPGTSPK LWIYSTSNLA SGVPARFSGS GSGTSYSLTI SRMEAEDAAT YYCQQRSSYP LTFGAGTKLE LKRAAAGSGG SGFVPVFLPA KPTTTPAPRP PTPAPTIASQ PLSLRPEACR PAAGGAVHTR GLDFACDIYI WAPLAGTCGV LLLSLVITLY CNHRNRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 50 | CD2_MFE23 _spCD8 _CD28_CD4 0 | MSFPCKFVAS FLLIFNVSSK GAVSQVKLQQ SGAELVRSGT SVKLSCTASG FNIKDSYMHW LRQGPEQGLE WIGWIDPENG DTEYAPKFQG KATFTTDTSS NTAYLQLSSL TSEDTAVYYC NEGTPTGPYY FDYWGQGTTV TVSSGGGGSG GGGSGGGGSE NVLTQSPAIM SASPGEKVTI TCSASSSVSY MHWFQQKPGT SPKLWIYSTS NLASGVPARF SGSGSGTSYS LTISRMEAED AATYYCQQRS SYPLTFGAGT KLELKRAAAG SGGGSGFVPVF LPAKPTTTPA PRPPTPAPTI ASQPLSLRPE ACRPAAGGAV HTRGLDFACD IYIWAPLAGT CGVLLLSLVI TLYCNHRNRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 51 | IL2_MFE23 _spCD8 _CD28_CD4 0 | MYRMQLLSCI ALSLALVTNS QVKLQQSGAE LVRSGTSVKL SCTASGFNIK DSYMHWLRQG PEQGLEWIGW IDPENGDTEY APKFQGKATF TTDTSSNTAY LQLSSLTSED TAVYYCNEGT PTGPYYFDYW GQGTTVTVSS GGGGSGGGGS GGGGSENVLT QSPAIMSASP GEKVTITCSA SSSVSYMHWF QQKPGTSPKL WIYSTSNLAS GVPARFSGSG SGTSYSLTIS RMEAEDAATY YCQQRSSYPL TFGAGTKLEL KRAAAGSGGS GFVPVFLPAK PTTTPAPRPP TPAPTIASQP LSLRPEACRP AAGGAVHTRG LDFACDIYIW APLAGTCGVL LLSLVITLYC NHRNRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 52 | GM-CSF_MFE23 _spCD8 _CD28_CD4 0 | MWLQSLLLLG TVACSISQVK LQQSGAELVR SGTSVKLSCT ASGFNIKDSY MHWLRQGPEQ GLEWIGWIDP ENGDTEYAPK FQGKATFTTD TSSNTAYLQL SSLTSEDTAV YYCNEGTPTG PYYFDYWGQG TTVTVSSGGG GSGGGGSGGG GSENVLTQSP AIMSASPGEK VTITCSASSS VSYMHWFQQK PGTSPKLWIY STSNLASGVP ARFSGSGSGT SYSLTISRME AEDAATYYCQ QRSSYPLTFG AGTKLELKRA AAGSGGSGFV PVFLPAKPTT TPAPRPPTPA PTIASQPLSL RPEACRPAAG GAVHTRGLDF ACDIYIWAPL AGTCGVLLLS LVITLYCNHR NRSKRSRLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |
| 53 | hIgGk-VIII_MFE2 3 _spCD8 _CD28_CD4 0 | MEAPAQLLFL LLLWLPDTTR QVKLQQSGAE LVRSGTSVKL SCTASGFNIK DSYMHWLRQG PEQGLEWIGW IDPENGDTEY APKFQGKATF TTDTSSNTAY LQLSSLTSED TAVYYCNEGT PTGPYYFDYW GQGTTVTVSS GGGGSGGGGS GGGGSENVLT QSPAIMSASP GEKVTITCSA SSSVSYMHWF QQKPGTSPKL WIYSTSNLAS GVPARFSGSG SGTSYSLTIS RMEAEDAATY YCQQRSSYPL TFGAGTKLEL KRAAAGSGGS GFVPVFLPAK PTTTPAPRPP TPAPTIASQP LSLRPEACRP AAGGAVHTRG LDFACDIYIW APLAGTCGVL LLSLVITLYC NHRNRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 54 | OSM_MFE23 _CD28TM _CD28_CD4 0 | MGVLLTQRTL LSLVLALLFP SMASMQVKLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR |

TABLE 7-continued

Amino Acid Sequences

| ID No | Component | Sequence |
|---|---|---|
| | | SSYPLTFGAG TKLELKRAAA GSGGSGFWVL VVVGGVLACY SLLVTVAFII FWVRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 55 | CD8a_MFE23 _CD28TM _CD28_CD4 0 | MALPVTALLL PLALLLHAAR PQVKLQQSGA ELVRSGTSVK LSCTASGFNI KDSYMHWLRQ GPEQGLEWIG WIDPENGDTE YAPKFQGKAT FTTDTSSNTA YLQLSSLTSE DTAVYYCNEG TPTGPYYFDY WGQGTTVTVS SGGGGSGGGG SGGGGSENVL TQSPAIMSAS PGEKVTITCS ASSSVSYMHW FQQKPGTSPK LWIYSTSNLA SGVPARFSGS GSGTSYSLTI SRMEAEDAAT YYCQQRSSYP LTFGAGTKLE LKRAAAGSGG SGFWVLVVVG GVLACYSLLV TVAFIIFWVR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 56 | CD2_MFE23 _CD28TM _CD28_CD4 0 | MSFPCKFVAS FLLIFNVSSK GAVSQVKLQQ SGAELVRSGT SVKLSCTASG FNIKDSYMHW LRQGPEQGLE WIGWIDPENG DTEYAPKFQG KATFTTDTSS NTAYLQLSSL TSEDTAVYYC NEGTPTGPYY FDYWGQGTTV TVSSGGGGSG GGGSGGGGSE NVLTQSPAIM SASPGEKVTI TCSASSSVSY MHWFQQKPGT SPKLWIYSTS NLASGVPARF SGSGSGTSYS LTISRMEAED AATYYCQQRS SYPLTFGAGT KLELKRAAAG SGGSGFWVLV VVGGVLACYS LLVTVAFIIF WVRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 57 | IL2_MFE23 _CD28TM _CD28_CD4 0 | MYRMQLLSCI ALSLALVTNS QVKLQQSGAE LVRSGTSVKL SCTASGFNIK DSYMHWLRQG PEQGLEWIGW IDPENGDTEY APKFQGKATF TTDTSSNTAY LQLSSLTSED TAVYYCNEGT PTGPYYFDYW GQGTTVTVSS GGGGSGGGGS GGGGSENVLT QSPAIMSASP GEKVTITCSA SSSVSYMHWF QQKPGTSPKL WIYSTSNLAS GVPARFSGSG SGTSYSLTIS RMEAEDAATY YCQQRSSYPL TFGAGTKLEL KRAAAGSGGS GFWVLVVVGG VLACYSLLVT VAFIIFWVRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 58 | GM-CSF_MFE23 _CD28TM _CD28_CD4 0 | MWLQSLLLLG TVACSISQVK LQQSGAELVR SGTSVKLSCT ASGFNIKDSY MHWLRQGPEQ GLEWIGWIDP ENGDTEYAPK FQGKATFTTD TSSNTAYLQL SSLTSEDTAV YYCNEGTPTG PYYFDYWGQG TTVTVSSGGG GSGGGGSGGG GSENVLTQSP AIMSASPGEK VTITCSASSS VSYMHWFQQK PGTSPKLWIY STSNLASGVP ARFSGSGSGT SYSLTISRME AEDAATYYCQ QRSSYPLTFG AGTKLELKRA AAGSGGSGFW VLVVVGGVLA CYSLLVTVAF IIFWVRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 59 | hIgGk-VIII_MFE2 3 _CD28TM _CD28_CD4 0 | MEAPAQLLFL LLLWLPDTTR QVKLQQSGAE LVRSGTSVKL SCTASGFNIK DSYMHWLRQG PEQGLEWIGW IDPENGDTEY APKFQGKATF TTDTSSNTAY LQLSSLTSED TAVYYCNEGT PTGPYYFDYW GQGTTVTVSS GGGGSGGGGS GGGGSENVLT QSPAIMSASP GEKVTITCSA SSSVSYMHWF QQKPGTSPKL WIYSTSNLAS GVPARFSGSG SGTSYSLTIS RMEAEDAATY YCQQRSSYPL TFGAGTKLEL KRAAAGSGGS GFWVLVVVGG VLACYSLLVT VAFIIFWVRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 60 | OSM_MFE23 (K > Q) _spCD28 _CD28_CD4 0 CTP219 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGSGILVK QSPMLVAYDN AVNLSCKYSY NLFSREFRAS LHKGLDSAVE VCVVYGNYSQ QLQVYSKTGF NCDGKLGNES VTFYLQNLYV NQTDIYFCKI EVMYPPPYLD NEKSNGTIIH VKGKHLCPSP LFPGPSKPFW VLVVVGGVLA CYSLLVTVAF IIFWVRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 61 | CD8a_MFE2 3 (K > Q)_ spCD28 _CD28_CD4 0 | MALPVTALLL PLALLLHAAR PQVQLQQSGA ELVRSGTSVK LSCTASGFNI KDSYMHWLRQ GPEQGLEWIG WIDPENGDTE YAPKFQGKAT FTTDTSSNTA YLQLSSLTSE DTAVYYCNEG TPTGPYYFDY WGQGTTVTVS SGGGGSGGGG SGGGGSENVL TQSPAIMSAS PGEKVTITCS ASSSVSYMHW FQQKPGTSPK LWIYSTSNLA SGVPARFSGS GSGTSYSLTI SRMEAEDAAT YYCQQRSSYP LTFGAGTKLE LKRAAAGSGG SGILVKQSPM LVAYDNAVNL SCKYSYNLFS REFRASLHKG LDSAVEVCVV YGNYSQQLQV YSKTGFNCDG KLGNESVTFY LQNLYVNQTD IYFCKIEVMY PPPYLDNEKS NGTIIHVKGK HLCPSPLFPG PSKPFWVLVV VGGVLACYSL LVTVAFIIFW VRSKRSRLLH SDYMNMTPRR |

TABLE 7-continued

Amino Acid Sequences

| ID No | Component | Sequence |
|---|---|---|
| | | PGPTRKHYQP YAPPRDFAAY RSKKVAKKPT NKAPHPKQEP QEINFPDDLP GSNTAAPVQE TLHGCQPVTQ EDGKESRISV QERQ |
| 62 | CD2_MFE23 (K > Q) _spCD28 _CD28_CD4 0 | MSFPCKFVAS FLLIFNVSSK GAVSQVQLQQ SGAELVRSGT SVKLSCTASG FNIKDSYMHW LRQGPEQGLE WIGWIDPENG DTEYAPKFQG KATFTTDTSS NTAYLQLSSL TSEDTAVYYC NEGTPTGPYY FDYWGQGTTV TVSSGGGGSG GGGSGGGGSE NVLTQSPAIM SASPGEKVTI TCSASSSVSY MHWFQQKPGT SPKLWIYSTS NLASGVPARF SGSGSGTSYS LTISRMEAED AATYYCQQRS SYPLTFGAGT KLELKRAAAG SGGGGILVKQ SPMLVAYDNA VNLSCKYSYN LFSREFRASL HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 63 | IL2_MFE23 (K > Q) spCD28 _CD28_CD4 0 | MYRMQLLSCI ALSLALVTNS QVQLQQSGAE LVRSGTSVKL SCTASGFNIK DSYMHWLRQG PEQGLEWIGW IDPENGDTEY APKFQGKATF TTDTSSNTAY LQLSSLTSED TAVYYCNEGT PTGPYYFDYW GQGTTVTVSS GGGGSGGGGS GGGGSENVLT QSPAIMSASP GEKVTITCSA SSSVSYMHWF QQKPGTSPKL WIYSTSNLAS GVPARFSGSG SGTSYSLTIS RMEAEDAATY YCQQRSSYPL TFGAGTKLEL KRAAAGSGGG ILVKQSPML VAYDNAVNLS CKYSYNLFSR EFRASLHKGL DSAVEVCVVY GNYSQQLQVY SKTGFNCDGK LGNESVTFYL QNLYVNQTDI YFCKIEVMYP PPYLDNEKSN GTIIHVKGKH LCPSPLFPGP SKPFWVLVVV GGVLACYSLL VTVAFIIFWV RSKRSLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |
| 64 | GM-CSF _MFE23 (K > Q) _spCD28 _CD28_CD4 0 | MWLQSLLLLG TVACSISQVQ LQQSGAELVR SGTSVKLSCT ASGFNIKDSY MHWLRQGPEQ GLEWIGWIDP ENGDTEYAPK FQGKATFTTD TSSNTAYLQL SSLTSEDTAV YYCNEGTPTG PYYFDYWGQG TTVTVSSGGG GSGGGGSGGG GSENVLTQSP AIMSASPGEK VTITCSASSS VSYMHWFQQK PGTSPKLWIY STSNLASGVP ARFSGSGSGT SYSLTISRME AEDAATYYCQ QRSSYPLTFG AGTKLELKRA AAGSGGSGIL VKQSPMLVAY DNAVNLSCKY SYNLFSREFR ASLHKGLDSA VEVCVVYGNY SQQLQVYSKT GFNCDGKLGN ESVTFYLQNL YVNQTDIYFC KIEVMYPPPY LDNEKSNGTI IHVKGKHLCP SPLFPGPSKP FWVLVVVGGV LACYSLLVTV AFIIFWVRSK RSLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |
| 65 | hIgGk-VIII _MFE23 (K > Q) _spCD28 _CD28_CD4 0 | MEAPAQLLFL LLLWLPDTTR QVQLQQSGAE LVRSGTSVKL SCTASGFNIK DSYMHWLRQG PEQGLEWIGW IDPENGDTEY APKFQGKATF TTDTSSNTAY LQLSSLTSED TAVYYCNEGT PTGPYYFDYW GQGTTVTVSS GGGGSGGGGS GGGGSENVLT QSPAIMSASP GEKVTITCSA SSSVSYMHWF QQKPGTSPKL WIYSTSNLAS GVPARFSGSG SGTSYSLTIS RMEAEDAATY YCQQRSSYPL TFGAGTKLEL KRAAAGSGGG ILVKQSPML VAYDNAVNLS CKYSYNLFSR EFRASLHKGL DSAVEVCVVY GNYSQQLQVY SKTGFNCDGK LGNESVTFYL QNLYVNQTDI YFCKIEVMYP PPYLDNEKSN GTIIHVKGKH LCPSPLFPGP SKPFWVLVVV GGVLACYSLL VTVAFIIFWV RSKRSLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |
| 66 | OSM_MFE23 (K > Q) _spCD8 _CD28_CD4 0 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGSGFVPV FLPAKPTTTP APRPPTPAPT IASQPLSLRP EACRPAAGGA VHTRGLDFAC DIYIWAPLAG TCGVLLLSLV ITLYCNHRNR SKRSLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 67 | CD8a _MFE23 (K > Q) _spCD8 _CD28_CD4 0 | MALPVTALLL PLALLLHAAR PQVQLQQSGA ELVRSGTSVK LSCTASGFNI KDSYMHWLRQ GPEQGLEWIG WIDPENGDTE YAPKFQGKAT FTTDTSSNTA YLQLSSLTSE DTAVYYCNEG TPTGPYYFDY WGQGTTVTVS SGGGGSGGGG SGGGGSENVL TQSPAIMSAS PGEKVTITCS ASSSVSYMHW FQQKPGTSPK LWIYSTSNLA SGVPARFSGS GSGTSYSLTI SRMEAEDAAT YYCQQRSSYP LTFGAGTKLE LKRAAAGSGG SGFVPVFLPA KPTTTPAPRP PTPAPTIASQ PLSLRPEACR PAAGGAVHTR GLDFACDIYI WAPLAGTCGV LLLSLVITLY CNHRNRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |

TABLE 7-continued

Amino Acid Sequences

| ID No | Component | Sequence |
|---|---|---|
| 68 | CD2_MFE23 (K > Q) _spCD8 _CD28_CD4 0 | MSFPCKFVAS FLLIFNVSSK GAVSQVQLQQ SGAELVRSGT SVKLSCTASG FNIKDSYMHW LRQGPEQGLE WIGWIDPENG DTEYAPKFQG KATFTTDTSS NTAYLQLSSL TSEDTAVYYC NEGTPTGPYY FDYWGQGTTV TVSSGGGGSG GGGSGGGGSE NVLTQSPAIM SASPGEKVTI TCSASSSVSY MHWFQQKPGT SPKLWIYSTS NLASGVPARF SGSGSGTSYS LTISRMEAED AATYYCQQRS SYPLTFGAGT KLELKRAAAG SGGGSGFVPVF LPAKPTTTPA PRPPTPAPTI ASQPLSLRPE ACRPAAGGAV HTRGLDFACD IYIWAPLAGT CGVLLLSLVI TLYCNHRNRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 69 | IL2_MFE23 (K > Q) _spCD8 _CD28_CD4 0 | MYRMQLLSCI ALSLALVTNS QVQLQQSGAE LVRSGTSVKL SCTASGFNIK DSYMHWLRQG PEQGLEWIGW IDPENGDTEY APKFQGKATF TTDTSSNTAY LQLSSLTSED TAVYYCNEGT PTGPYYFDYW GQGTTVTVSS GGGGSGGGGS GGGGSENVLT QSPAIMSASP GEKVTITCSA SSSVSYMHWF QQKPGTSPKL WIYSTSNLAS GVPARFSGSG SGTSYSLTIS RMEAEDAATY YCQQRSSYPL TFGAGTKLEL KRAAGSGGG GFVPVFLPAK PTTTPAPRPP TPAPTIASQP LSLRPEACRP AAGGAVHTRG LDFACDIYIW APLAGTCGVL LLSLVITLYC NHRNRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 70 | GM-CSF _MFE23 (K > Q) _spCD8 _CD28_CD4 0 | MWLQSLLLLG TVACSISQVQ LQQSGAELVR SGTSVKLSCT ASGFNIKDSY MHWLRQGPEQ GLEWIGWIDP ENGDTEYAPK FQGKATFTTD TSSNTAYLQL SSLTSEDTAV YYCNEGTPTG PYYFDYWGQG TTVTVSSGGG GSGGGGSGGG GSENVLTQSP AIMSASPGEK VTITCSASSS VSYMHWFQQK PGTSPKLWIY STSNLASGVP ARFSGSGSGT SYSLTISRME AEDAATYYCQ QRSSYPLTFG AGTKLELKRA AGSGGGSGFV PVFLPAKPTT TPAPRPPTPA PTIASQPLSL RPEACRPAAG GAVHTRGLDF ACDIYIWAPL AGTCGVLLLS LVITLYCNHR NRSKRSRLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |
| 71 | hIgGk-VIII _MFE23 (K > Q) _spCD8 _CD28_CD4 0 | MEAPAQLLFL LLLWLPDTTR QVQLQQSGAE LVRSGTSVKL SCTASGFNIK DSYMHWLRQG PEQGLEWIGW IDPENGDTEY APKFQGKATF TTDTSSNTAY LQLSSLTSED TAVYYCNEGT PTGPYYFDYW GQGTTVTVSS GGGGSGGGGS GGGGSENVLT QSPAIMSASP GEKVTITCSA SSSVSYMHWF QQKPGTSPKL WIYSTSNLAS GVPARFSGSG SGTSYSLTIS RMEAEDAATY YCQQRSSYPL TFGAGTKLEL KRAAAGSGGG GFVPVFLPAK PTTTPAPRPP TPAPTIASQP LSLRPEACRP AAGGAVHTRG LDFACDIYIW APLAGTCGVL LLSLVITLYC NHRNRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 72 | OSM_MFE23 (K > Q) _CD28TM _CD28_CD4 0 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGGSGFWVL VVVGGVLACY SLLVTVAFII FWVRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 73 | CD8a _MFE23 (K > Q) _CD28TM _CD28_CD4 0 | MALPVTALLL PLALLLHAAR PQVQLQQSGA ELVRSGTSVK LSCTASGFNI KDSYMHWLRQ GPEQGLEWIG WIDPENGDTE YAPKFQGKAT FTTDTSSNTA YLQLSSLTSE DTAVYYCNEG TPTGPYYFDY WGQGTTVTVS SGGGGSGGGG SGGGGSENVL TQSPAIMSAS PGEKVTITCS ASSSVSYMHW FQQKPGTSPK LWIYSTSNLA SGVPARFSGS GSGTSYSLTI SRMEAEDAAT YYCQQRSSYP LTFGAGTKLE LKRAAAGSGG SGFWVLVVVG GVLACYSLLV TVAFIIFWVR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 74 | CD2_MFE23 (K > Q) _CD28TM _CD28_CD4 0 | MSFPCKFVAS FLLIFNVSSK GAVSQVQLQQ SGAELVRSGT SVKLSCTASG FNIKDSYMHW LRQGPEQGLE WIGWIDPENG DTEYAPKFQG KATFTTDTSS NTAYLQLSSL TSEDTAVYYC NEGTPTGPYY FDYWGQGTTV TVSSGGGGSG GGGSGGGGSE NVLTQSPAIM SASPGEKVTI TCSASSSVSY MHWFQQKPGT SPKLWIYSTS NLASGVPARF SGSGSGTSYS LTISRMEAED AATYYCQQRS SYPLTFGAGT KLELKRAAAG SGGGSGFWVLV VVGGVLACYS LLVTVAFIIF WVRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |

TABLE 7-continued

Amino Acid Sequences

| ID No | Component | Sequence |
|---|---|---|
| 75 | IL2_MFE23 (K > Q) _CD28TM _CD28_CD40 | MYRMQLLSCI ALSLALVTNS QVQLQQSGAE LVRSGTSVKL SCTASGFNIK DSYMHWLRQG PEQGLEWIGW IDPENGDTEY APKFQGKATF TTDTSSNTAY LQLSSLTSED TAVYYCNEGT PTGPYYFDYW GQGTTVTVSS GGGGSGGGGS GGGGSENVLT QSPAIMSASP GEKVTITCSA SSSVSYMHWF QQKPGTSPKL WIYSTSNLAS GVPARFSGSG SGTSYSLTIS RMEAEDAATY YCQQRSSYPL TFGAGTKLEL KRAAGSGGS GFWVLVVVGG VLACYSLLVT VAFIIFWVRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 76 | GM-CSF _MFE23 (K > Q) _CD28TM _CD28_CD40 | MWLQSLLLLG TVACSISQVQ LQQSGAELVR SGTSVKLSCT ASGFNIKDSY MHWLRQGPEQ GLEWIGWIDP ENGDTEYAPK FQGKATFTTD TSSNTAYLQL SSLTSEDTAV YYCNEGTPTG PYYFDYWGQG TTVTVSSGGG GSGGGGSGGG GSENVLTQSP AIMSASPGEK VTITCSASSS VSYMHWFQQK PGTSPKLWIY STSNLASGVP ARFSGSGSGT SYSLTISRME AEDAATYYCQ QRSSYPLTFG AGTKLELKRA AGSGGSGFW VLVVVGGVLA CYSLLVTVAF IIFWVRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 77 | hIgGk-VIII _MFE23 (K > Q) _CD28TM _CD28_CD40 | MEAPAQLLFL LLLWLPDTTR QVQLQQSGAE LVRSGTSVKL SCTASGFNIK DSYMHWLRQG PEQGLEWIGW IDPENGDTEY APKFQGKATF TTDTSSNTAY LQLSSLTSED TAVYYCNEGT PTGPYYFDYW GQGTTVTVSS GGGGSGGGGS GGGGSENVLT QSPAIMSASP GEKVTITCSA SSSVSYMHWF QQKPGTSPKL WIYSTSNLAS GVPARFSGSG SGTSYSLTIS RMEAEDAATY YCQQRSSYPL TFGAGTKLEL KRAAGSGGS GFWVLVVVGG VLACYSLLVT VAFIIFWVRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 78 | OSM_HuMFE 23 _spCD28 _CD28_CD40 CTP220 | MGVLLTQRTL LSLVLALLFP SMASMQVKLE QSGAEVVKPG ASVKLSCKAS GFNIKDSYMH WLRQGPGQRL EWIGWIDPEN GDTEYAPKFQ GKATFTTDTS ANTAYLGLSS LRPEDTAVYY CNEGTPTGPY YFDYWGQGTL VTVSSGGGGS GGGGSGGGGS ENVLTQSPSS MSASVGDRVN IACSASSSVS YMHWFQQKPG KSPKLWIYST SNLASGVPSR FSGSGSGTDY SLTISSMQPE DAATYYCQQR SSYPLTFGGG TKLEIKAAAG SGGSGILVKQ SPMLVAYDNA VNLSCKYSYN LFSREFRASL HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 79 | CD8a_HuMF E23 _spCD28 _CD28_CD40 | MALPVTALLL PLALLLHAAR PQVKLEQSGA EVVKPGASVK LSCKASGFNI KDSYMHWLRQ GPGQRLEWIG WIDPENGDTE YAPKFQGKAT FTTDTSANTA YLGLSSLRPE DTAVYYCNEG TPTGPYYFDY WGQGTLVTVS SGGGGSGGGG SGGGGSENVL TQSPSSMSAS VGDRVNIACS ASSSVSYMHW FQQKPGKSPK LWIYSTSNLA SGVPSRFSGS GSGTDYSLTI SSMQPEDAAT YYCQQRSSYP LTFGGGTKLE IKAAAGSGGS GILVKQSPML VAYDNAVNLS CKYSYNLFSR EFRASLHKGL DSAVEVCVVY GNYSQQLQVY SKTGFNCDGK LGNESVTFYL QNLYVNQTDI YFCKIEVMYP PPYLDNEKSN GTIIHVKGKH LCPSPLFPGP SKPFWVLVVV GGVLACYSLL VTVAFIIFWV RSKRSRLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |
| 80 | CD2_HuMFE 23 _spCD28 _CD28_CD40 | MSFPCKFVAS FLLIFNVSSK GAVSQVKLEQ SGAEVVKPGA SVKLSCKASG FNIKDSYMHW LRQGPGQRLE WIGWIDPENG DTEYAPKFQG KATFTTDTSA NTAYLGLSSL RPEDTAVYYC NEGTPTGPYY FDYWGQGTLV TVSSGGGGSG GGGSGGGGSE NVLTQSPSSM SASVGDRVNI ACSASSSVSY MHWFQQKPGK SPKLWIYSTS NLASGVPSRF SGSGSGTDYS LTISSMQPED AATYYCQQRS SYPLTFGGGT KLEIKAAAGS GGSGILVKQS PMLVAYDNAV NLSCKYSYNL FSREFRASLH KGLDSAVEVC VVYGNYSQQL QVYSKTGFNC DGKLGNESVT FYLQNLYVNQ TDIYFCKIEV MYPPPYLDNE KSNGTIIHVK GKHLCPSPLF PGPSKPFWVL VVVGGVLACY SLLVTVAFII FWVRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 81 | IL2_HuMFE 23 _spCD28 _CD28_CD40 | MYRMQLLSCI ALSLALVTNS QVKLEQSGAE VVKPGASVKL SCKASGFNIK DSYMHWLRQG PGQRLEWIGW IDPENGDTEY APKFQGKATF TTDTSANTAY LGLSSLRPED TAVYYCNEGT PTGPYYFDYW GQGTLVTVSS GGGGSGGGGS GGGGSENVLT QSPSSMSASV GDRVNIACSA SSSVSYMHWF QQKPGKSPKL WIYSTSNLAS GVPSRFSGSG SGTDYSLTIS SMQPEDAATY YCQQRSSYPL TFGGGTKLEI KAAAGSGGSG ILVKQSPMLV AYDNAVNLSC KYSYNLFSRE FRASLHKGLD SAVEVCVVYG NYSQQLQVYS KTGFNCDGKL GNESVTFYLQ NLYVNQTDIY FCKIEVMYPP PYLDNEKSNG TIIHVKGKHL CPSPLFPGPS |

TABLE 7-continued

Amino Acid Sequences

| ID No | Component | Sequence |
|---|---|---|
| | | KPFWVLVVVG GVLACYSLLV TVAFIIFWVR SKRSLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 82 | GM-CSF_HuMFE23_spCD28_CD28_CD40 | MWLQSLLLLG TVACSISQVK LEQSGAEVVK PGASVKLSCK ASGFNIKDSY MHWLRQGPGQ RLEWIGWIDP ENGDTEYAPK FQGKATFTTD TSANTAYLGL SSLRPEDTAV YYCNEGTPTG PYYFDYWGQG TLVTVSSGGG GSGGGGSGGG GSENVLTQSP SSMSASVGDR VNIACSASSS VSYMHWFQQK PGKSPKLWIY STSNLASGVP SRFSGSGSGT DYSLTISSMQ PEDAATYYCQ QRSSYPLTFG GGTKLEIKAA AGSGGSGILV KQSPMLVAYD NAVNLSCKYS YNLFSREFRA SLHKGLDSAV EVCVVYGNYS QQLQVYSKTG FNCDGKLGNE SVTFYLQNLY VNQTDIYFCK IEVMYPPPYL DNEKSNGTII HVKGKHLCPS PLFPGPSKPF WVLVVVGGVL ACYSLLVTVA FIIFWVRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |
| 83 | hIgGk-VIII_HuMFE23_spCD28_CD28_CD40 | MEAPAQLLFL LLLWLPDTTR QVKLEQSGAE VVKPGASVKL SCKASGFNIK DSYMHWLRQG PGQRLEWIGW IDPENGDTEY APKFQGKATF TTDTSANTAY LGLSSLRPED TAVYYCNEGT PTGPYYFDYW GQGTLVTVSS GGGGSGGGGS GGGGSENVLT QSPSSMSASV GDRVNIACSA SSSVSYMHWF QQKPGKSPKL WIYSTSNLAS GVPSRFSGSG SGTDYSLTIS SMQPEDAATY YCQQRSSYPL TFGGGTKLEI KAAAGSGGGS ILVKQSPMLV AYDNAVNLSC KYSYNLFSRE FRASLHKGLD SAVEVCVVYG NYSQQLQVYS KTGFNCDGKL GNESVTFYLQ NLYVNQTDIY FCKIEVMYPP YLDNEKSNG TIIHVKGKHL CPSPLFPGPS KPFWVLVVVG GVLACYSLLV TVAFIIFWVR SKRSLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 84 | OSM_HuMFE23_spCD8_CD28_CD40 CTP232 | MGVLLTQRTL LSLVLALLFP SMASMQVKLE QSGAEVVKPG ASVKLSCKAS GFNIKDSYMH WLRQGPGQRL EWIGWIDPEN GDTEYAPKFQ GKATFTTDTS ANTAYLGLSS LRPEDTAVYY CNEGTPTGPY YFDYWGQGTL VTVSSGGGGS GGGGSGGGGS ENVLTQSPSS MSASVGDRVN IACSASSSVS YMHWFQQKPG KSPKLWIYST SNLASGVPSR FSGSGSGTDY SLTISSMQPE DAATYYCQQR SSYPLTFGGG TKLEIKAAAG SGGGSGFVPVF LPAKPTTTPA PRPPTPAPTI ASQPLSLRPE ACRPAAGGAV HTGRLDFACD IYIWAPLAGT CGVLLLSLVI TLYCNHRNRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 85 | CD8a_HuMFE23_spCD8_CD28_CD40 | MALPVTALLL PLALLLHAAR PQVKLEQSGA EVVKPGASVK LSCKASGFNI KDSYMHWLRQ GPGQRLEWIG WIDPENGDTE YAPKFQGKAT FTTDTSANTA YLGLSSLRPE DTAVYYCNEG TPTGPYYFDY WGQGTLVTVS SGGGGSGGGG SGGGGSENVL TQSPSSMSAS VGDRVNIACS ASSSVSYMHW FQQKPGKSPK LWIYSTSNLA SGVPSRFSGS GSGTDYSLTI SSMQPEDAAT YYCQQRSSYP LTFGGGTKLE IKAAAGSGGG GFVPVFLPAK PTTTPAPRPP TPAPTIASQP LSLRPEACRP AAGGAVHTRG LDFACDIYIW APLAGTCGVL LLSLVITLYC NHRNRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 86 | CD2_HuMFE23_spCD8_CD28_CD40 | MSFPCKFVAS FLLIFNVSSK GAVSQVKLEQ SGAEVVKPGA SVKLSCKASG FNIKDSYMHW LRQGPGQRLE WIGWIDPENG DTEYAPKFQG KATFTTDTSA NTAYLGLSSL RPEDTAVYYC NEGTPTGPYY FDYWGQGTLV TVSSGGGGSG GGGSGGGGSE NVLTQSPSSM SASVGDRVNI ACSASSSVSY MHWFQQKPGK SPKLWIYSTS NLASGVPSRF SGSGSGTDYS LTISSMQPED AATYYCQQRS SYPLTFGGGT KLEIKAAAGS GGGSGFVPVFL PAKPTTTPAP RPPTPAPTIA SQPLSLRPEA CRPAAGGAVH TRGLDFACDI YIWAPLAGTC GVLLLSLVIT LYCNHRNRSK RSRLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |
| 87 | IL2_HuMFE23_spCD8_CD28_CD40 | MYRMQLLSCI ALSLALVTNS QVKLEQSGAE VVKPGASVKL SCKASGFNIK DSYMHWLRQG PGQRLEWIGW IDPENGDTEY APKFQGKATF TTDTSANTAY LGLSSLRPED TAVYYCNEGT PTGPYYFDYW GQGTLVTVSS GGGGSGGGGS GGGGSENVLT QSPSSMSASV GDRVNIACSA SSSVSYMHWF QQKPGKSPKL WIYSTSNLAS GVPSRFSGSG SGTDYSLTIS SMQPEDAATY YCQQRSSYPL TFGGGTKLEI KAAAGSGGGS FVPVFLPAKP TTTPAPRPPT PAPTIASQPL SLRPEACRPA AGGAVHTRGL DFACDIYIWA PLAGTCGVLL LSLVITLYCN HRNRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |

TABLE 7-continued

Amino Acid Sequences

| ID No | Component | Sequence |
|---|---|---|
| 88 | GM-CSF_HuMFE23_spCD8_CD28_CD40 | MWLQSLLLLG TVACSISQVK LEQSGAEVVK PGASVKLSCK ASGFNIKDSY MHWLRQGPGQ RLEWIGWIDP ENGDTEYAPK FQGKATFTTD TSANTAYLGL SSLRPEDTAV YYCNEGTPTG PYYFDYWGQG TLVTVSSGGG GSGGGGSGGG GSENVLTQSP SSMSASVGDR VNIACSASSS VSYMHWFQQK PGKSPKLWIY STSNLASGVP SRFSGSGSGT DYSLTISSMQ PEDAATYYCQ QRSSYPLTFG GGTKLEIKAA AGSGGSGFVP VFLPAKPTTT PAPRPPTPAP TIASQPLSLR PEACRPAAGG AVHTRGLDFA CDIYIWAPLA GTCGVLLLSL VITLYCNHRN RSKRSRLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |
| 89 | hIgGk-VIII_HuMFE23_spCD8_CD28_CD40 | MEAPAQLLFL LLLWLPDTTR QVKLEQSGAE VVKPGASVKL SCKASGFNIK DSYMHWLRQG PGQRLEWIGW IDPENGDTEY APKFQGKATF TTDTSANTAY LGLSSLRPED TAVYYCNEGT PTGPYYFDYW GQGTLVTVSS GGGGSGGGGS GGGGSENVLT QSPSSMSASV GDRVNIACSA SSSVSYMHWF QQKPGKSPKL WIYSTSNLAS GVPSRFSGSG SGTDYSLTIS SMQPEDAATY YCQQRSSYPL TFGGGTKLEI KAAAGSGGSG FVPVFLPAKP TTTPAPRPPT PAPTIASQPL SLRPEACRPA AGGAVHTRGL DFACDIYIWA PLAGTCGVLL LSLVITLYCN HRNRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 90 | OSM_HuMFE23_CD28TM_CD28_CD40 | MGVLLTQRTL LSLVLALLFP SMASMQVKLE QSGAEVVKPG ASVKLSCKAS GFNIKDSYMH WLRQGPGQRL EWIGWIDPEN GDTEYAPKFQ GKATFTTDTS ANTAYLGLSS LRPEDTAVYY CNEGTPTGPY YFDYWGQGTL VTVSSGGGGS GGGGSGGGGS ENVLTQSPSS MSASVGDRVN IACSASSSVS YMHWFQQKPG KSPKLWIYST SNLASGVPSR FSGSGSGTDY SLTISSMQPE DAATYYCQQR SSYPLTFGGG TKLEIKAAAG SGGSGFWVLV VVGGVLACYS LLVTVAFIIF WVRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 91 | CD8a_HuMFE23_CD28TM_CD28_CD40 | MALPVTALLL PLALLLHAAR PQVKLEQSGA EVVKPGASVK LSCKASGFNI KDSYMHWLRQ GPGQRLEWIG WIDPENGDTE YAPKFQGKAT FTTDTSANTA YLGLSSLRPE DTAVYYCNEG TPTGPYYFDY WGQGTLVTVS SGGGGSGGGG SGGGGSENVL TQSPSSMSAS VGDRVNIACS ASSSVSYMHW FQQKPGKSPK LWIYSTSNLA SGVPSRFSGS GSGTDYSLTI SSMQPEDAAT YYCQQRSSYP LTFGGGTKLE IKAAAGSGGS GFWVLVVVGG VLACYSLLVT VAFIIFWVRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 92 | CD2_HuMFE23_CD28TM_CD28_CD40 | MSFPCKFVAS FLLIFNVSSK GAVSQVKLEQ SGAEVVKPGA SVKLSCKASG FNIKDSYMHW LRQGPGQRLE WIGWIDPENG DTEYAPKFQG KATFTTDTSA NTAYLGLSSL RPEDTAVYYC NEGTPTGPYY FDYWGQGTLV TVSSGGGGSG GGGSGGGGSE NVLTQSPSSM SASVGDRVNI ACSASSSVSY MHWFQQKPGK SPKLWIYSTS NLASGVPSRF SGSGSGTDYS LTISSMQPED AATYYCQQRS SYPLTFGGGT KLEIKAAAGS GGSGFWVLVV VGGVLACYSL LVTVAFIIFW VRSKRSRLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |
| 93 | IL2_HuMFE23_CD28TM_CD28_CD40 | MYRMQLLSCI ALSLALVTNS QVKLEQSGAE VVKPGASVKL SCKASGFNIK DSYMHWLRQG PGQRLEWIGW IDPENGDTEY APKFQGKATF TTDTSANTAY LGLSSLRPED TAVYYCNEGT PTGPYYFDYW GQGTLVTVSS GGGGSGGGGS GGGGSENVLT QSPSSMSASV GDRVNIACSA SSSVSYMHWF QQKPGKSPKL WIYSTSNLAS GVPSRFSGSG SGTDYSLTIS SMQPEDAATY YCQQRSSYPL TFGGGTKLEI KAAAGSGGSG FWVLVVVGGV LACYSLLVTV AFIIFWVRSK RSRLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |
| 94 | GM-CSF_HuMFE23_CD28TM_CD28_CD40 | MWLQSLLLLG TVACSISQVK LEQSGAEVVK PGASVKLSCK ASGFNIKDSY MHWLRQGPGQ RLEWIGWIDP ENGDTEYAPK FQGKATFTTD TSANTAYLGL SSLRPEDTAV YYCNEGTPTG PYYFDYWGQG TLVTVSSGGG GSGGGGSGGG GSENVLTQSP SSMSASVGDR VNIACSASSS VSYMHWFQQK PGKSPKLWIY STSNLASGVP SRFSGSGSGT DYSLTISSMQ PEDAATYYCQ QRSSYPLTFG GGTKLEIKAA AGSGGSGFWV LVVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |

TABLE 7-continued

Amino Acid Sequences

| ID No | Component | Sequence |
|---|---|---|
| 95 | hIgGk-VIII_HuMFE23_CD28TM_CD28_CD40 | MEAPAQLLFL LLLWLPDTTR QVKLEQSGAE VVKPGASVKL SCKASGFNIK DSYMHWLRQG PGQRLEWIGW IDPENGDTEY APKFQGKATF TTDTSANTAY LGLSSLRPED TAVYYCNEGT PTGPYYFDYW GQGTLVTVSS GGGGSGGGGS GGGGSENVLT QSPSSMSASV GDRVNIACSA SSSVSYMHWF QQKPGKSPKL WIYSTSNLAS GVPSRFSGSG SGTDYSLTIS SMQPEDAATY YCQQRSSYPL TFGGGTKLEI KAAAGSGGGS FWVLVVVGGV LACYSLLVTV AFIIFWVRSK RSRLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |
| 96 | OSM_CEA6_spCD28_CD28_CD40 CTP221 | MGVLLTQRTL LSLVLALLFP SMASMQVLV QSGAEVKKPG SSVKVSCKAS GGTFSNSPIN WLRQAPGQGL EWMGSIIPSF GTANYAQKFQ GRLTITADES TSTAYMELSS LRSEDTAVYY CAGRSHNYEL YYYYMDVWGQ GTMVTVSSGG GGSGGGGSGG GGSDIQMTQS PSTLSASIGD RVTITCRASE GIYHWLAWYQ QKPGKAPKLL IYKASSLASG APSRFSGSGS GTDFTLTISS LQPDDFATYY CQQYSNYPLT FGGGTKLEIK RAAAGSGGGS ILVKQSPMLV AYDNAVNLSC KYSYNLFSRE FRASLHKGLD SAVEVCVVYG NYSQQLQVYS KTGFNCDGKL GNESVTFYLQ NLYVNQTDIY FCKIEVMYPP PYLDNEKSNG TIIHVKGKHL CPSPLFPGPS KPFWVLVVVG GVLACYSLLV TVAFIIFWVR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 97 | CD8a_CEA6_spCD28_CD28_CD40 | MALPVTALLL PLALLLHAAR PQVQLVQSGA EVKKPGSSVK VSCKASGGTF SNSPINWLRQ APGQGLEWMG SIIPSFGTAN YAQKFQGRLT ITADESTSTA YMELSSLRSE DTAVYYCAGR SHNYELYYYY MDVWGQGTMV TVSSGGGGSG GGGSGGGGSD IQMTQSPSTL SASIGDRVTI TCRASEGIYH WLAWYQQKPG KAPKLLIYKA SSLASGAPSR FSGSGSGTDF TLTISSLQPD DFATYYCQQY SNYPLTFGGG TKLEIKRAAA GSGGGSILVK QSPMLVAYDN AVNLSCKYSY NLFSREFRAS LHKGLDSAVE VCVVYGNYSQ QLQVYSKTGF NCDGKLGNES VTFYLQNLYV NQTDIYFCKI EVMYPPPYLD NEKSNGTIIH VKGKHLCPSP LFPGPSKPFW VLVVVGGVLA CYSLLVTVAF IIFWVRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 98 | CD2_CEA6_spCD28_CD28_CD40 | MSFPCKFVAS FLLIFNVSSK GAVSQVQLVQ SGAEVKKPGS SVKVSCKASG GTFSNSPINW LRQAPGQGLE WMGSIIPSFG TANYAQKFQG RLTITADEST STAYMELSSL RSEDTAVYYC AGRSHNYELY YYYMDVWGQG TMVTVSSGGG GSGGGGSGGG GSDIQMTQSP STLSASIGDR VTITCRASEG IYHWLAWYQQ KPGKAPKLLI YKASSLASGA PSRFSGSGSG TDFTLTISSL QPDDFATYYC QQYSNYPLTF GGGTKLEIKR AAAGSGGGSI LVKQSPMLVA YDNAVNLSCK YSYNLFSREF RASLHKGLDS AVEVCVVYGN YSQQLQVYSK TGFNCDGKLG NESVTFYLQN LYVNQTDIYF CKIEVMYPPP YLDNEKSNGT IIHVKGKHLC PSPLFPGPSK PFWVLVVVGG VLACYSLLVT VAFIIFWVRS KRSLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 99 | IL2_CEA6_spCD28_CD28_CD40 | MYRMQLLSCI ALSLALVTNS QVQLVQSGAE VKKPGSSVKV SCKASGGTFS NSPINWLRQA PGQGLEWMGS IIPSFGTANY AQKFQGRLTI TADESTSTAY MELSSLRSED TAVYYCAGRS HNYELYYYYM DVWGQGTMVT VSSGGGGSGG GGSGGGGSDI QMTQSPSTLS ASIGDRVTIT CRASEGIYHW LAWYQQKPGK APKLLIYKAS SLASGAPSRF SGSGSGTDFT LTISSLQPDD FATYYCQQYS NYPLTFGGGT KLEIKRAAAG SGGGSILVKQ SPMLVAYDNA VNLSCKYSYN LFSREFRASL HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 100 | GM-CSF_CEA6_spCD28_CD28_CD40 | MWLQSLLLLG TVACSISQVQ LVQSGAEVKK PGSSVKVSCK ASGGTFSNSP INWLRQAPGQ GLEWMGSIIP SFGTANYAQK FQGRLTITAD ESTSTAYMEL SSLRSEDTAV YYCAGRSHNY ELYYYYMDVW GQGTMVTVSS GGGGSGGGGS GGGGSDIQMT QSPSTLSASI GDRVTITCRA SEGIYHWLAW YQQKPGKAPK LLIYKASSLA SGAPSRFSGS GSGTDFTLTI SSLQPDDFAT YYCQQYSNYP LTFGGGTKLE IKRAAAGSGG GSILVKQSPM LVAYDNAVNL SCKYSYNLFS REFRASLHKG LDSAVEVCVV YGNYSQQLQV YSKTGFNCDG KLGNESVTFY LQNLYVNQTD IYFCKIEVMY PPPYLDNEKS NGTIIHVKGK HLCPSPLFPG PSKPFWVLVV VGGVLACYSL LVTVAFIIFW VRSKRSRLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |

TABLE 7-continued

Amino Acid Sequences

| ID No | Component | Sequence |
|---|---|---|
| 101 | hIgGk-VIII_CEA6_spCD28_CD28_CD4 0 | MEAPAQLLFL LLLWLPDTTR QVQLVQSGAE VKKPGSSVKV SCKASGGTFS NSPINWLRQA PGQGLEWMGS IIPSFGTANY AQKFQGRLTI TADESTSTAY MELSSLRSED TAVYYCAGRS HNYELYYYYM DVWGQGTMVT VSSGGGGSGG GGSGGGGSDI QMTQSPSTLS ASIGDRVTIT CRASEGIYHW LAWYQQKPGK APKLLIYKAS SLASGAPSRF SGSGSGTDFT LTISSLQPDD FATYYCQQYS NYPLTFGGGT KLEIKRAAAG SGGSGILVKQ SPMLVAYDNA VNLSCKYSYN LFSREFRASL HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 102 | OSM_CEA6_spCD8_CD28_CD4 0 | MGVLLTQRTL LSLVLALLFP SMASMQVQLV QSGAEVKKPG SSVKVSCKAS GGTFSNSPIN WLRQAPGQGL EWMGSIIPSF GTANYAQKFQ GRLTITADES TSTAYMELSS LRSEDTAVYY CAGRSHNYEL YYYYMDVWGQ GTMVTVSSGG GGSGGGGSGG GGSDIQMTQS PSTLSASIGD RVTITCRASE GIYHWLAWYQ QKPGKAPKLL IYKASSLASG APSRFSGSGS GTDFTLTISS LQPDDFATYY CQQYSNYPLT FGGGTKLEIK RAAAGSGGSG FVPVFLPAKP TTTPAPRPPT PAPTIASQPL SLRPEACRPA AGGAVHTRGL DFACDIYIWA PLAGTCGVLL LSLVITLYCN HRNRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 103 | CD8a_CEA6_spCD8_CD28_CD4 0 | MALPVTALLL PLALLLHAAR PQVQLVQSGA EVKKPGSSVK VSCKASGGTF SNSPINWLRQ APGQGLEWMG SIIPSFGTAN YAQKFQGRLT ITADESTSTA YMELSSLRSE DTAVYYCAGR SHNYELYYYY MDVWGQGTMV TVSSGGGGSG GGGSGGGGSD IQMTQSPSTL SASIGDRVTI TCRASEGIYH WLAWYQQKPG KAPKLLIYKA SSLASGAPSR FSGSGSGTDF TLTISSLQPD DFATYYCQQY SNYPLTFGGG TKLEIKRAAA GSGGSGFVPV FLPAKPTTTP APRPPTPAPT IASQPLSLRP EACRPAAGGA VHTRGLDFAC DIYIWAPLAG TCGVLLLSLV ITLYCNHRNR SKRSLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 104 | CD2_CEA6_spCD8_CD28_CD4 0 | MSFPCKFVAS FLLIFNVSSK GAVSQVQLVQ SGAEVKKPGS SVKVSCKASG GTFSNSPINW LRQAPGQGLE WMGSIIPSFG TANYAQKFQG RLTITADEST STAYMELSSL RSEDTAVYYC AGRSHNYELY YYYMDVWGQG TMVTVSSGGG GSGGGGSGGG GSGSDIQMTQSP STLSASIGDR VTITCRASEG IYHWLAWYQQ KPGKAPKLLI YKASSLASGA PSRFSGSGSG TDFTLTISSL QPDDFATYYC QQYSNYPLTF GGGTKLEIKR AAAGSGGSGF VPVFLPAKPT TTPAPRPPTP APTIASQPLS LRPEACRPAG GAVHTRGLD FACDIYIWAP LAGTCGVLLL SLVITLYCNH RNRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 105 | IL2_CEA6_spCD8_CD28_CD4 0 | MYRMQLLSCI ALSLALVTNS QVQLVQSGAE VKKPGSSVKV SCKASGGTFS NSPINWLRQA PGQGLEWMGS IIPSFGTANY AQKFQGRLTI TADESTSTAY MELSSLRSED TAVYYCAGRS HNYELYYYYM DVWGQGTMVT VSSGGGGSGG GGSGGGGSDI QMTQSPSTLS ASIGDRVTIT CRASEGIYHW LAWYQQKPGK APKLLIYKAS SLASGAPSRF SGSGSGTDFT LTISSLQPDD FATYYCQQYS NYPLTFGGGT KLEIKRAAAG SGGSGFVPVF LPAKPTTTPA PRPPTPAPTI ASQPLSLRPE ACRPAAGGAV HTRGLDFACD IYIWAPLAGT CGVLLLSLVI TLYCNHRNRS KRSLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 106 | GM-CSF_CEA6_spCD8_CD28_CD4 0 | MWLQSLLLLG TVACSISQVQ LVQSGAEVKK PGSSVKVSCK ASGGTFSNSP INWLRQAPGQ GLEWMGSIIP SFGTANYAQK FQGRLTITAD ESTSTAYMEL SSLRSEDTAV YYCAGRSHNY ELYYYYMDVW GQGTMVTVSS GGGGSGGGGS GGGGSDIQMT QSPSTLSASI GDRVTITCRA SEGIYHWLAW YQQKPGKAPK LLIYKASSLA SGAPSRFSGS GSGTDFTLTI SSLQPDDFAT YYCQQYSNYP LTFGGGTKLE IKRAAAGSGG SGFVPVFLPA KPTTTPAPRP PTPAPTIASQ PLSLRPEACR PAAGGAVHTR GLDFACDIYI WAPLAGTCGV LLLSLVITLY CNHRNRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 107 | hIgGk-VIII_CEA6_spCD8_CD28_CD4 0 | MEAPAQLLFL LLLWLPDTTR QVQLVQSGAE VKKPGSSVKV SCKASGGTFS NSPINWLRQA PGQGLEWMGS IIPSFGTANY AQKFQGRLTI TADESTSTAY MELSSLRSED TAVYYCAGRS HNYELYYYYM DVWGQGTMVT VSSGGGGSGG GGSGGGGSDI QMTQSPSTLS ASIGDRVTIT CRASEGIYHW LAWYQQKPGK APKLLIYKAS SLASGAPSRF SGSGSGTDFT LTISSLQPDD FATYYCQQYS NYPLTFGGGT KLEIKRAAAG SGGSGFVPVF LPAKPTTTPA PRPPTPAPTI ASQPLSLRPE ACRPAAGGAV HTRGLDFACD IYIWAPLAGT CGVLLLSLVI |

TABLE 7-continued

Amino Acid Sequences

| ID No | Component | Sequence |
|---|---|---|
| | | TLYCNHRNRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 108 | OSM_CEA6 _CD28TM _CD28_CD4 0 | MGVLLTQRTL LSLVLALLFP SMASMQVQLV QSGAEVKKPG SSVKVSCKAS GGTFSNSPIN WLRQAPGQGL EWMGSIIPSF GTANYAQKFQ GRLTITADES TSTAYMELSS LRSEDTAVYY CAGRSHNYEL YYYYMDVWGQ GTMVTVSSGG GGSGGGGSGG GGSDIQMTQS PSTLSASIGD RVTITCRASE GIYHWLAWYQ QKPGKAPKLL IYKASSLASG APSRFSGSGS GTDFTLTISS LQPDDFATYY CQQYSNYPLT FGGGTKLEIK RAAAGSGGSG FWVLVVVGGV LACYSLLVTV AFIIFWVRSK RSRLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |
| 109 | CD8a_CEA6 _CD28TM _CD28_CD4 0 | MALPVTALLL PLALLLHAAR PQVQLVQSGA EVKKPGSSVK VSCKASGGTF SNSPINWLRQ APGQGLEWMG SIIPSFGTAN YAQKFQGRLT ITADESTSTA YMELSSLRSE DTAVYYCAGR SHNYELYYYY MDVWGQGTMV TVSSGGGGSG GGGSGGGGSD IQMTQSPSTL SASIGDRVTI TCRASEGIYH WLAWYQQKPG KAPKLLIYKA SSLASGAPSR FSGSGSGTDF TLTISSLQPD DFATYYCQQY SNYPLTFGGG TKLEIKRAAA GSGGSGFWVL VVVGGVLACY SLLVTVAFII FWVRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 110 | CD2_CEA6 _CD28TM _CD28_CD4 0 | MSFPCKFVAS FLLIFNVSSK GAVSQVQLVQ SGAEVKKPGS SVKVSCKASG GTFSNSPINW LRQAPGQGLE WMGSIIPSFG TANYAQKFQG RLTITADEST STAYMELSSL RSEDTAVYYC AGRSHNYELY YYYMDVWGQG TMVTVSSGGG GSGGGGSGGG GSDIQMTQSP STLSASIGDR VTITCRASEG IYHWLAWYQQ KPGKAPKLLI YKASSLASGA PSRFSGSGSG TDFTLTISSL QPDDFATYYC QQYSNYPLTF GGGTKLEIKR AAAGSGGSGF WVLVVVGGVL ACYSLLVTVA FIIFWVRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |
| 111 | IL2_CEA6 _CD28TM _CD28_CD4 0 | MYRMQLLSCI ALSLALVTNS QVQLVQSGAE VKKPGSSVKV SCKASGGTFS NSPINWLRQA PGQGLEWMGS IIPSFGTANY AQKFQGRLTI TADESTSTAY MELSSLRSED TAVYYCAGRS HNYELYYYYM DVWGQGTMVT VSSGGGGSGG GGSGGGGSDI QMTQSPSTLS ASIGDRVTIT CRASEGIYHW LAWYQQKPGK APKLLIYKAS SLASGAPSRF SGSGSGTDFT LTISSLQPDD FATYYCQQYS NYPLTFGGGT KLEIKRAAAG SGGSGFWVLV VVGGVLACYS LLVTVAFIIF WVRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 112 | GM-CSF_CEA6 _CD28TM _CD28_CD4 0 | MWLQSLLLLG TVACSISQVQ LVQSGAEVKK PGSSVKVSCK ASGGTFSNSP INWLRQAPGQ GLEWMGSIIP SFGTANYAQK FQGRLTITAD ESTSTAYMEL SSLRSEDTAV YYCAGRSHNY ELYYYYMDVW GQGTMVTVSS GGGGSGGGGS GGGGSDIQMT QSPSTLSASI GDRVTITCRA SEGIYHWLAW YQQKPGKAPK LLIYKASSLA SGAPSRFSGS GSGTDFTLTI SSLQPDDFAT YYCQQYSNYP LTFGGGTKLE IKRAAAGSGG SGFWVLVVVG GVLACYSLLV TVAFIIFWVR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 113 | hIgGk-VIII _CEA6 _CD28TM _CD28_CD4 0 | MEAPAQLLFL LLLWLPDTTR QVQLVQSGAE VKKPGSSVKV SCKASGGTFS NSPINWLRQA PGQGLEWMGS IIPSFGTANY AQKFQGRLTI TADESTSTAY MELSSLRSED TAVYYCAGRS HNYELYYYYM DVWGQGTMVT VSSGGGGSGG GGSGGGGSDI QMTQSPSTLS ASIGDRVTIT CRASEGIYHW LAWYQQKPGK APKLLIYKAS SLASGAPSRF SGSGSGTDFT LTISSLQPDD FATYYCQQYS NYPLTFGGGT KLEIKRAAAG SGGSGFWVLV VVGGVLACYS LLVTVAFIIF WVRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 114 | OSM_BW431/26 _spCD28 _CD28_CD4 0 CTP222 | MGVLLTQRTL LSLVLALLFP SMASMQLQES GPGLVRPSQT LSLTCTVSGF TISSGYSWHW VRQPPGRGLE WIGYIQYSGI TNYNPSLKSR VTMLVDTSKN QFSLRLSSVT AADTAVYYCA REDYDHWYF DVWGQGSLVT VSSGGGGSGG GGSGGGGSGV HSDIQMTQSP SSLSASVGDR VTITCSTSSS VSYMHWYQQK PGKAPKLLIY STSNLASGVP SRFSGSGSGT DFTFTISSLQ PEDIATYYCH QWSSYPTFGQ GTKVEIKRAA AGSGGGSILV KQSPMLVAYD NAVNLSCKYS YNLFSREFRA SLHKGLDSAV EVCVVYGNYS QQLQVYSKTG FNCDGKLGNE SVTFYLQNLY VNQTDIYFCK IEVMYPPPYL DNEKSNGTII HVKGKHLCPS |

TABLE 7-continued

Amino Acid Sequences

| ID No | Component | Sequence |
|---|---|---|
| | | PLFPGPSKPF WVLVVVGGVL ACYSLLVTVA FIIFWVRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |
| 115 | CD8a_BW43 1/26 _spCD28 _CD28_CD4 0 | MALPVTALLL PLALLLHAAR PQLQESGPGL VRPSQTLSLT CTVSGFTISS GYSWHWVRQP PGRGLEWIGY IQYSGITNYN PSLKSRVTML VDTSKNQFSL RLSSVTAADT AVYYCAREDY DHWYFDVWG QGSLVTVSSG GGGSGGGGSG GGGSGVHSDI QMTQSPSSLS ASVGDRVTIT CSTSSSVSYM HWYQQKPGKA PKLLIYSTSN LASGVPSRFS GSGSGTDFTF TISSLQPEDI ATYYCHQWSS YPTFGQGTKV EIKRAAAGSG GSGILVKQSP MLVAYDNAVN LSCKYSYNLF SREFRASLHK GLDSAVEVCV VYGNYSQQLQ VYSKTGFNCD GKLGNESVTF YLQNLYVNQT DIYFCKIEVM YPPPYLDNEK SNGTIIHVKG KHLCPSPLFP GPSKPFWVLV VVGGVLACYS LLVTVAFIIF WVRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 116 | CD2_BW431/ 26 _spCD28 _CD28_CD4 0 | MSFPCKFVAS FLLIFNVSSK GAVSQLQESG PGLVRPSQTL SLTCTVSGFT ISSGYSWHWV RQPPGRGLEW IGYIQYSGIT NYNPSLKSRV TMLVDTSKNQ FSLRLSSVTA ADTAVYYCAR EDYDHWYFD VWGQGSLVTV SSGGGGSGGG GSGGGGSGVH SDIQMTQSPS SLSASVGDRV TITCSTSSSV SYMHWYQQKP GKAPKLLIYS TSNLASGVPS RFSGSGSGTD FTFTISSLQP EDIATYYCHQ WSSYPTFGQG TKVEIKRAAA GSGGSGILVK QSPMLVAYDN AVNLSCKYSY NLFSREFRAS LHKGLDSAVE VCVVYGNYSQ QLQVYSKTGF NCDGKLGNES VTFYLQNLYV NQTDIYFCKI EVMYPPPYLD NEKSNGTIIH VKGKHLCPSP LFPGPSKPFW VLVVVGGVLA CYSLLVTVAF IIFWVRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 117 | IL2_BW431/ 26 _spCD28 _CD28_CD4 0 | MYRMQLLSCI ALSLALVTNS QLQESGPGLV RPSQTLSLTC TVSGFTISSG YSWHWVRQPP GRGLEWIGYI QYSGITNYNP SLKSRVTMLV DTSKNQFSLR LSSVTAADTA VYYCAREDYD HWYFDVWGQ GSLVTVSSGG GGSGGGGSGG GGSGVHSDIQ MTQSPSSLSA SVGDRVTITC STSSSVSYMH WYQQKPGKAP KLLIYSTSNL ASGVPSRFSG SGSGTDFTFT ISSLQPEDIA TYYCHQWSSY PTFGQGTKVE IKRAAAGSGG SGILVKQSPM LVAYDNAVNL SCKYSYNLFS REFRASLHKG LDSAVEVCVV YGNYSQQLQV YSKTGFNCDG KLGNESVTFY LQNLYVNQTD IYFCKIEVMY PPPYLDNEKS NGTIIHVKGK HLCPSPLFPG PSKPFWVLVV VGGVLACYSL LVTVAFIIFW VRSKRSRLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |
| 118 | GM-CSF _BW431/26 _spCD28 _CD28_CD4 0 | MWLQSLLLLG TVACSISQLQ ESGPGLVRPS QTLSLTCTVS GFTISSGYSW HWVRQPPGRG LEWIGYIQYS GITNYNPSLK SRVTMLVDTS KNQFSLRLSS VTAADTAVYY CAREDYDHW YFDVWGQGSL VTVSSGGGGS GGGGSGGGGS GVHSDIQMTQ SPSSLSASVG DRVTITCSTS SSVSYMHWYQ QKPGKAPKLL IYSTSNLASG VPSRFSGSGS GTDFTFTISS LQPEDIATYY CHQWSSYPTF GQGTKVEIKR AAAGSGGSGI LVKQSPMLVA YDNAVNLSCK YSYNLFSREF RASLHKGLDS AVEVCVVYGN YSQQLQVYSK TGFNCDGKLG NESVTFYLQN LYVNQTDIYF CKIEVMYPPP YLDNEKSNGT IIHVKGKHLC PSPLFPGPSK PFWVLVVGG VLACYSLLVT VAFIIFWVRS KRSLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 119 | hIgGk- VIII _BW431/26 _spCD28 _CD28_CD4 0 | MEAPAQLLFL LLLWLPDTTR QLQESGPGLV RPSQTLSLTC TVSGFTISSG YSWHWVRQPP GRGLEWIGYI QYSGITNYNP SLKSRVTMLV DTSKNQFSLR LSSVTAADTA VYYCAREDYD HWYFDVWGQ GSLVTVSSGG GGSGGGGSGG GGSGVHSDIQ MTQSPSSLSA SVGDRVTITC STSSSVSYMH WYQQKPGKAP KLLIYSTSNL ASGVPSRFSG SGSGTDFTFT ISSLQPEDIA TYYCHQWSSY PTFGQGTKVE IKRAAAGSGG SGILVKQSPM LVAYDNAVNL SCKYSYNLFS REFRASLHKG LDSAVEVCVV YGNYSQQLQV YSKTGFNCDG KLGNESVTFY LQNLYVNQTD IYFCKIEVMY PPPYLDNEKS NGTIIHVKGK HLCPSPLFPG PSKPFWVLVV VGGVLACYSL LVTVAFIIFW VRSKRSRLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |
| 120 | OSM_BW431/ 26 _spCD8 _CD28_CD4 0 | MGVLLTQRTL LSLVLALLFP SMASMQLQES GPGLVRPSQT LSLTCTVSGF TISSGYSWHW VRQPPGRGLE WIGYIQYSGI TNYNPSLKSR VTMLVDTSKN QFSLRLSSVT AADTAVYYCA REDYDHWYF DVWGQGSLVT VSSGGGGSGG GGSGGGGSGV HSDIQMTQSP SSLSASVGDR VTITCSTSSS VSYMHWYQQK PGKAPKLLIY STSNLASGVP SRFSGSGSGT DFTFTISSLQ PEDIATYYCH QWSSYPTFGQ GTKVEIKRAA AGSGGGSGFVP VFLPAKPTTT PAPRPPTPAP TIASQPLSLR PEACRPAAGG AVHTRGLDFA CDIYIWAPLA GTCGVLLLSL VITLYCNHRN RSKRSRLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |

TABLE 7-continued

Amino Acid Sequences

| ID No | Component | Sequence |
|---|---|---|
| 121 | CD8a_BW43 1/26 _spCD8 _CD28_CD4 0 | MALPVTALLL PLALLLHAAR PQLQESGPGL VRPSQTLSLT CTVSGFTISS GYSWHWVRQP PGRGLEWIGY IQYSGITNYN PSLKSRVTML VDTSKNQFSL RLSSVTAADT AVYYCAREDY DYHWYFDVWG QGSLVTVSSG GGGSGGGSG GGGSGVHSDI QMTQSPSSLS ASVGDRVTIT CSTSSSVSYM HWYQQKPGKA PKLLIYSTSN LASGVPSRFS GSGSGTDFTF TISSLQPEDI ATYYCHQWSS YPTFGQGTKV EIKRAAAGSG GSGFVPVFLP AKPTTTPAPR PPTPAPTIAS QPLSLRPEAC RPAAGGAVHT RGLDFACDIY IWAPLAGTCG VLLLSLVITL YCNHRNRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |
| 122 | CD2_BW431/ 26 _spCD8 _CD28_CD4 0 | MSFPCKFVAS FLLIFNVSSK GAVSQLQESG PGLVRPSQTL SLTCTVSGFT ISSGYSWHWV RQPPGRGLEW IGYIQYSGIT NYNPSLKSRV TMLVDTSKNQ FSLRLSSVTA ADTAVYYCAR EDYDHWYFD VWGQGSLVTV SSGGGGSGGG GSGGGGSGVH SDIQMTQSPS SLSASVGDRV TITCSTSSSV SYMHWYQQKP GKAPKLLIYS TSNLASGVPS RFSGSGSGTD FTFTISSLQP EDIATYYCHQ WSSYPTFGQG TKVEIKRAAA GSGGSGFVPV FLPAKPTTTP APRPPTPAPT IASQPLSLRP EACRPAAGGA VHTRGLDFAC DIYIWAPLAG TCGVLLLSLV ITLYCNHRNR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 123 | IL2_BW431/ 26 _spCD8 _CD28_CD4 0 | MYRMQLLSCI ALSLALVTNS QLQESGPGLV RPSQTLSLTC TVSGFTISSG YSWHWVRQPP GRGLEWIGYI QYSGITNYNP SLKSRVTMLV DTSKNQFSLR LSSVTAADTA VYYCAREDY YHWYFDVWGQ GSLVTVSSGG GGSGGGGSGG GGSGVHSDIQ MTQSPSSLSA SVGDRVTITC STSSSVSYMH WYQQKPGKAP KLLIYSTSNL ASGVPSRFSG SGSGTDFTFT ISSLQPEDIA TYYCHQWSSY PTFGQGTKVE IKRAAAGSGG SGFVPVFLPA KPTTTPAPRP PTPAPTIASQ PLSLRPEACR PAAGGAVHTR GLDFACDIYI WAPLAGTCGV LLLSLVITLY CNHRNRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 124 | GM-CSF_BW431/ 26 _spCD8 _CD28_CD4 0 | MWLQSLLLLG TVACSISQLQ ESGPGLVRPS QTLSLTCTVS GFTISSGYSW HWVRQPPGRG LEWIGYIQYS GITNYNPSLK SRVTMLVDTS KNQFSLRLSS VTAADTAVYY CAREDYDHW YFDVWGQGSL VTVSSGGGGS GGGGSGGGGS GVHSDIQMTQ SPSSLSASVG DRVTITCSTS SSVSYMHWYQ QKPGKAPKLL IYSTSNLASG VPSRFSGSGS GTDFTFTISS LQPEDIATYY CHQWSSYPTF GQGTKVEIKR AAAGSGGSGF VPVFLPAKPT TTPAPRPPTP APTIASQPLS LRPEACRPAA GGAVHTRGLD FACDIYIWAP LAGTCGVLLL SLVITLYCNH RNRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 125 | hIgGk-VIII_BW43 1/26 _spCD8 _CD28_CD4 0 | MEAPAQLLFL LLLWLPDTTR QLQESGPGLV RPSQTLSLTC TVSGFTISSG YSWHWVRQPP GRGLEWIGYI QYSGITNYNP SLKSRVTMLV DTSKNQFSLR LSSVTAADTA VYYCAREDY DHWYFDVWGQ GSLVTVSSGG GGSGGGGSGG GGSGVHSDIQ MTQSPSSLSA SVGDRVTITC STSSSVSYMH WYQQKPGKAP KLLIYSTSNL ASGVPSRFSG SGSGTDFTFT ISSLQPEDIA TYYCHQWSSY PTFGQGTKVE IKRAAAGSGG SGFVPVFLPA KPTTTPAPRP PTPAPTIASQ PLSLRPEACR PAAGGAVHTR GLDFACDIYI WAPLAGTCGV LLLSLVITLY CNHRNRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 126 | OSM_BW431/ 26 _CD28TM _CD28_CD4 0 | MGVLLTQRTL LSLVLALLFP SMASMQLQES GPGLVRPSQT LSLTCTVSGF TISSGYSWHW VRQPPGRGLE WIGYIQYSGI TNYNPSLKSR VTMLVDTSKN QFSLRLSSVT AADTAVYYCA REDYDHWYF DVWGQGSLVT VSSGGGGSGG GGSGGGGSGV HSDIQMTQSP SSLSASVGDR VTITCSTSSS VSYMHWYQQK PGKAPKLLIY STSNLASGVP SRFSGSGSGT DFTFTISSLQ PEDIATYYCH QWSSYPTFGQ GTKVEIKRAA AGSGGSGFWV LVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 127 | CD8a_BW43 1/26 _CD28TM _CD28_CD4 0 | MALPVTALLL PLALLLHAAR PQLQESGPGL VRPSQTLSLT CTVSGFTISS GYSWHWVRQP PGRGLEWIGY IQYSGITNYN PSLKSRVTML VDTSKNQFSL RLSSVTAADT AVYYCAREDY DYHWYFDVWG QGSLVTVSSG GGGSGGGGSG GGGSGVHSDI QMTQSPSSLS ASVGDRVTIT CSTSSSVSYM HWYQQKPGKA PKLLIYSTSN LASGVPSRFS GSGSGTDFTF TISSLQPEDI ATYYCHQWSS YPTFGQGTKV EIKRAAAGSG GSGFWVLVVV GGVLACYSLL VTVAFIIFWV RSKRSRLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |

TABLE 7-continued

Amino Acid Sequences

| ID No | Component | Sequence |
|---|---|---|
| 128 | CD2_BW431/26_CD28TM_CD28_CD4 0 | MSFPCKFVAS FLLIFNVSSK GAVSQLQESG PGLVRPSQTL SLTCTVSGFT ISSGYSWHWV RQPPGRGLEW IGYIQYSGIT NYNPSLKSRV TMLVDTSKNQ FSLRLSSVTA ADTAVYYCAR EDYDYHWYFD VWGQGSLVTV SSGGGGSGGG GSGGGGSGVH SDIQMTQSPS SLSASVGDRV TITCSTSSSV SYMHWYQQKP GKAPKLLIYS TSNLASGVPS RFSGSGSGTD FTFTISSLQP EDIATYYCHQ WSSYPTFGQG TKVEIKRAAA GSGGGSGFWVL VVVGGVLACY SLLVTVAFII FWVRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 129 | IL2_BW431/26_CD28TM_CD28_CD4 0 | MYRMQLLSCI ALSLALVTNS QLQESGPGLV RPSQTLSLTC TVSGFTISSG YSWHWVRQPP GRGLEWIGYI QYSGITNYNP SLKSRVTMLV DTSKNQFSLR LSSVTAADTA VYYCAREDYD YHWYFDVWGQ GSLVTVSSGG GGSGGGGSGG GGSGVHSDIQ MTQSPSSLSA SVGDRVTITC STSSSVSYMH WYQQKPGKAP KLLIYSTSNL ASGVPSRFSG SGSGTDFTFT ISSLQPEDIA TYYCHQWSSY PTFGQGTKVE IKRAAAGSGG SGFWVLVVVG GVLACYSLLV TVAFIIFWVR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 130 | GM-CSF_BW431/26_CD28TM_CD28_CD4 0 | MWLQSLLLLG TVACSISQLQ ESGPGLVRPS QTLSLTCTVS GFTISSGYSW HWVRQPPGRG LEWIGYIQYS GITNYNPSLK SRVTMLVDTS KNQFSLRLSS VTAADTAVYY CAREDYDYHW YFDVWGQGSL VTVSSGGGGS GGGGSGGGGS GVHSDIQMTQ SPSSLSASVG DRVTITCSTS SSVSYMHWYQ QKPGKAPKLL IYSTSNLASG VPSRFSGSGS GTDFTFTISS LQPEDIATYY CHQWSSYPTF GQGTKVEIKR AAAGSGGSGF WVLVVVGGVL ACYSLLVTVA FIIFWVRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |
| 131 | hIgGk-VIII_BW431/26_CD28TM_CD28_CD4 0 | MEAPAQLLFL LLLWLPDTTR QLQESGPGLV RPSQTLSLTC TVSGFTISSG YSWHWVRQPP GRGLEWIGYI QYSGITNYNP SLKSRVTMLV DTSKNQFSLR LSSVTAADTA VYYCAREDYD YHWYFDVWGQ GSLVTVSSGG GGSGGGGSGG GGSGVHSDIQ MTQSPSSLSA SVGDRVTITC STSSSVSYMH WYQQKPGKAP KLLIYSTSNL ASGVPSRFSG SGSGTDFTFT ISSLQPEDIA TYYCHQWSSY PTFGQGTKVE IKRAAAGSGG SGFWVLVVVG GVLACYSLLV TVAFIIFWVR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 132 | OSM_HuT84.66_spCD28_CD28_CD4 0 CTP223 | MGVLLTQRTL LSLVLALLFP SMASMEVQLV ESGGGLVQPG GSLRLSCAAS GFNIKDTYMH WVRQAPGKGL EWVARIDPAN GNSKYADSVK GRFTISADTS KNTAYLQMNS LRAEDTAVYY CAPFGYYVSD YAMAYWGQGT LVTVSSGGGG SGGGGSGGGG SDIQLTQSPS SLSASVGDRV TITCRAGESV DIFGVGFLHW YQQKPGKAPK LLIYRASNLE SGVPSRFSGS GSRTDFTLTI SSLQPEDFAT YYCQQTNEDP YTFGQGTKVE IKAAAGSGGS GILVKQSPML VAYDNAVNLS CKYSYNLFSR EFRASLHKGL DSAVEVCVVY GNYSQQLQVY SKTGFNCDGK LGNESVTFYL QNLYVNQTDI YFCKIEVMYP PYLDNEKSN GTIIHVKGKH LCPSPLFPGP SKPFWVLVVV GGVLACYSLL VTVAFIIFWV RSKRSRLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |
| 133 | CD8a_HuT84.66_spCD28_CD28_CD4 0 | MALPVTALLL PLALLLHAAR PEVQLVESGG GLVQPGGSLR LSCAASGFNI KDTYMHWVRQ APGKGLEWVA RIDPANGNSK YADSVKGRFT ISADTSKNTA YLQMNSLRAE DTAVYYCAPF GYYVSDYAMA YWGQGTLVTV SSGGGGSGGG GSGGGGSDIQ LTQSPSSLSA SVGDRVTITC RAGESVDIFG VGFLHWYQQK PGKAPKLLIY RASNLESGVP SRFSGSGSRT DFTLTISSLQ PEDFATYYCQ QTNEDPYTFG QGTKVEIKAA AGSGGGSGILV KQSPMLVAYD NAVNLSCKYS YNLFSREFRA SLHKGLDSAV EVCVVYGNYS QQLQVYSKTG FNCDGKLGNE SVTFYLQNLY VNQTDIYFCK IEVMYPPPYL DNEKSNGTII HVKGKHLCPS PLFPGPSKPF WVLVVVGGVL ACYSLLVTVA FIIFWVRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |
| 134 | CD2_HuT84.66_spCD28_CD28_CD4 0 | MSFPCKFVAS FLLIFNVSSK GAVSEVQLVE SGGGLVQPGG SLRLSCAASG FNIKDTYMHW VRQAPGKGLE WVARIDPANG NSKYADSVKG RFTISADTSK NTAYLQMNSL RAEDTAVYYC APFGYYVSDY AMAYWGQGTL VTVSSGGGGS GGGGSGGGGS DIQLTQSPSS LSASVGDRVT ITCRAGESVD IFGVGFLHWY QQKPGKAPKL LIYRASNLES GVPSRFSGSG SRTDFTLTIS SLQPEDFATY YCQQTNEDPY TFGQGTKVEI KAAAGSGGGS ILVKQSPMLV AYDNAVNLSC KYSYNLFSRE FRASLHKGLD SAVEVCVVYG NYSQQLQVYS KTGFNCDGKL GNESVTFYLQ NLYVNQTDIY FCKIEVMYPP PYLDNEKSNG TIIHVKGKHL CPSPLFPGPS KPFWVLVVVG GVLACYSLLV TVAFIIFWVR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |

TABLE 7-continued

Amino Acid Sequences

| ID No | Component | Sequence |
|---|---|---|
| 135 | IL2_HuT84.66_spCD28_CD4 | MYRMQLLSCI ALSLALVTNS EVQLVESGGG LVQPGGSLRL SCAASGFNIK DTYMHWVRQA PGKGLEWVAR IDPANGNSKY ADSVKGRFTI SADTSKNTAY LQMNSLRAED TAVYYCAPFG YYVSDYAMAY WGQGTLVTVS SGGGGSGGGG SGGGGSDIQL TQSPSSLSAS VGDRVTITCR AGESVDIFGV GFLHWYQQKP GKAPKLLIYR ASNLESGVPS RFSGSGSRTD FTLTISSLQP EDFATYYCQQ TNEDPYTFGQ GTKVEIKAAA GSGGGSILVK QSPMLVAYDN AVNLSCKYSY NLFSREFRAS LHKGLDSAVE VCVVYGNYSQ QLQVYSKTGF NCDGKLGNES VTFYLQNLYV NQTDIYFCKI EVMYPPPYLD NEKSNGTIIH VKGKHLCPSP LFPGPSKPFW VLVVVGGVLA CYSLLVTVAF IIFWVRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 136 | GM-CSF_HuT84.66_spCD28_CD4 | MWLQSLLLLG TVACSISEVQ LVESGGGLVQ PGGSLRLSCA ASGFNIKDTY MHWVRQAPGK GLEWVARIDP ANGNSKYADS VKGRFTISAD TSKNTAYLQM NSLRAEDTAV YYCAPFGYYV SDYAMAYWGQ GTLVTVSSGG GGSGGGGSGG GGSDIQLTQS PSSLSASVGD RVTITCRAGE SVDIFGVGFL HWYQQKPGKA PKLLIYRASN LESGVPSRFS GSGSRTDFTL TISSLQPEDF ATYYCQQTNE DPYTFGQGTK VEIKAAAGSG GSGILVKQSP MLVAYDNAVN LSCKYSYNLF SREFRASLHK GLDSAVEVCV VYGNYSQQLQ VYSKTGFNCD GKLGNESVTF YLQNLYVNQT DIYFCKIEVM YPPPYLDNEK SNGTIIHVKG KHLCPSPLFP GPSKPFWVLV VVGGVLACYS LLVTVAFIIF WVRSKRSLLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 137 | hIgGk-VIII_HuT84.66_spCD28_CD4 | MEAPAQLLFL LLLWLPDTTR EVQLVESGGG LVQPGGSLRL SCAASGFNIK DTYMHWVRQA PGKGLEWVAR IDPANGNSKY ADSVKGRFTI SADTSKNTAY LQMNSLRAED TAVYYCAPFG YYVSDYAMAY WGQGTLVTVS SGGGGSGGGG SGGGGSDIQL TQSPSSLSAS VGDRVTITCR AGESVDIFGV GFLHWYQQKP GKAPKLLIYR ASNLESGVPS RFSGSGSRTD FTLTISSLQP EDFATYYCQQ TNEDPYTFGQ GTKVEIKAAA GSGGGSILVK QSPMLVAYDN AVNLSCKYSY NLFSREFRAS LHKGLDSAVE VCVVYGNYSQ QLQVYSKTGF NCDGKLGNES VTFYLQNLYV NQTDIYFCKI EVMYPPPYLD NEKSNGTIIH VKGKHLCPSP LFPGPSKPFW VLVVVGGVLA CYSLLVTVAF IIFWVRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 138 | OSM_HuT84.66_spCD8_CD28_CD40 | MGVLLTQRTL LSLVLALLFP SMASMEVQLV ESGGGLVQPG GSLRLSCAAS GFNIKDTYMH WVRQAPGKGL EWVARIDPAN GNSKYADSVK GRFTISADTS KNTAYLQMNS LRAEDTAVYY CAPFGYYVSD YAMAYWGQGT LVTVSSGGGG SGGGGSGGGG SDIQLTQSPS SLSASVGDRV TITCRAGESV DIFGVGFLHW YQQKPGKAPK LLIYRASNLE SGVPSRFSGS GSRTDFTLTI SSLQPEDFAT YYCQQTNEDP YTFGQGTKVE IKAAAGSGGS GFVPVFLPAK PTTTPAPRPP TPAPTIASQP LSLRPEACRP AAGGAVHTRG LDFACDIYIW APLAGTCGVL LLSLVITLYC NHRNSKSRS LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 139 | CD8a_HuT84.66_spCD8_CD28_CD40 | MALPVTALLL PLALLLHAAR PEVQLVESGG GLVQPGGSLR LSCAASGFNI KDTYMHWVRQ APGKGLEWVA RIDPANGNSK YADSVKGRFT ISADTSKNTA YLQMNSLRAE DTAVYYCAPF GYYVSDYAMA YWGQGTLVTV SSGGGGSGGG GSGGGGSDIQ LTQSPSSLSA SVGDRVTITC RAGESVDIFG VGFLHWYQQK PGKAPKLLIY RASNLESGVP SRFSGSGSRT DFTLTISSLQ PEDFATYYCQ QTNEDPYTFG QGTKVEIKAA AGSGGSGFVP VFLPAKPTTT PAPRPPTPAP TIASQPLSLR PEACRPAAGG AVHTRGLDFA CDIYIWAPLA GTCGVLLLSL VITLYCNHRN RSKRSRLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |
| 140 | CD2_HuT84.66_spCD8_CD28_CD40 | MSFPCKFVAS FLLIFNVSSK GAVSEVQLVE SGGGLVQPGG SLRLSCAASG FNIKDTYMHW VRQAPGKGLE WVARIDPANG NSKYADSVKG RFTISADTSK NTAYLQMNSL RAEDTAVYYC APFGYYVSDY AMAYWGQGTL VTVSSGGGGS GGGGSGGGGS DIQLTQSPSS LSASVGDRVT ITCRAGESVD IFGVGFLHWY QQKPGKAPKL LIYRASNLES GVPSRFSGSG SRTDFTLTIS SLQPEDFATY YCQQTNEDPY TFGQGTKVEI KAAAGSGGSG FVPVFLPAKP TTTPAPRPPT PAPTIASQPL SLRPEACRPA AGGAVHTRGL DFACDIYIWA PLAGTCGVLL LSLVITLYCN HRNSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 141 | IL2_HuT84.66_spCD8_CD28_CD40 | MYRMQLLSCI ALSLALVTNS EVQLVESGGG LVQPGGSLRL SCAASGFNIK DTYMHWVRQA PGKGLEWVAR IDPANGNSKY ADSVKGRFTI SADTSKNTAY LQMNSLRAED TAVYYCAPFG YYVSDYAMAY WGQGTLVTVS SGGGGSGGGG SGGGGSDIQL TQSPSSLSAS VGDRVTITCR AGESVDIFGV GFLHWYQQKP GKAPKLLIYR ASNLESGVPS RFSGSGSRTD FTLTISSLQP EDFATYYCQQ TNEDPYTFGQ GTKVEIKAAA GSGGSGFVPV FLPAKPTTTP APRPPTPAPT |

TABLE 7-continued

Amino Acid Sequences

| ID No | Component | Sequence |
|---|---|---|
| | | IASQPLSLRP EACRPAAGGA VHTRGLDFAC DIYIWAPLAG TCGVLLLSLV<br>ITLYCNHRNR SKRSLLHSD YMNMTPRRPG PTRKHYQPYA PPRDFAAYRS<br>KKVAKKPTNK APHPKQEPQE INFPDDLPGS NTAAPVQETL HGCQPVTQED<br>GKESRISVQE RQ |
| 142 | GM-CSF_HuT84<br>.66<br>_spCD8<br>_CD28_CD4<br>0 | MWLQSLLLLG TVACSISEVQ LVESGGGLVQ PGGSLRLSCA ASGFNIKDTY<br>MHWVRQAPGK GLEWVARIDP ANGNSKYADS VKGRFTISAD TSKNTAYLQM<br>NSLRAEDTAV YYCAPFGYYV SDYAMAYWGQ GTLVTVSSGG GGSGGGGSGG<br>GGSDIQLTQS PSSLSASVGD RVTITCRAGE SVDIFGVGFL HWYQQKPGKA<br>PKLLIYRASN LESGVPSRFS GSGSRTDFTL TISSLQPEDF ATYYCQQTNE<br>DPYTFGQGTK VEIKAAAGSG GSGFVPVFLP AKPTTTPAPR PPTPAPTIAS<br>QPLSLRPEAC RPAAGGAVHT RGLDFACDIY IWAPLAGTCG VLLLSLVITL<br>YCNHRNRSKR SRLLHSDYMN MTPRRPGPTR KHYQPYAPPR DFAAYRSKKV<br>AKKPTNKAPH PKQEPQEINF PDDLPGSNTA APVQETLHGC QPVTQEDGKE<br>SRISVQERQ |
| 143 | hIgGk-<br>VIII_HuT8<br>4.66<br>_spCD8<br>_CD28_CD4<br>0 | MEAPAQLLFL LLLWLPDTTR EVQLVESGGG LVQPGGSRL SCAASGFNIK<br>DTYMHWVRQA PGKGLEWVAR IDPANGNSKY ADSVKGRFTI SADTSKNTAY<br>LQMNSLRAED TAVYYCAPFG YYVSDYAMAY WGQGTLVTVS SGGGGSGGGG<br>SGGGGSDIQL TQSPSSLSAS VGDRVTITCR AGESVDIFGV GFLHWYQQKP<br>GKAPKLLIYR ASNLESGVPS RFSGSGSRTD FTLTISSLQP EDFATYYCQQ<br>TNEDPYTFGQ GTKVEIKAAA GSGGSGFVPV FLPAKPTTTP APRPPTPAPT<br>IASQPLSLRP EACRPAAGGA VHTRGLDFAC DIYIWAPLAG TCGVLLLSLV<br>ITLYCNHRNR SKRSLLHSD YMNMTPRRPG PTRKHYQPYA PPRDFAAYRS<br>KKVAKKPTNK APHPKQEPQE INFPDDLPGS NTAAPVQETL HGCQPVTQED<br>GKESRISVQE RQ |
| 144 | OSM_HuT84<br>.66<br>_CD28TM<br>_CD28_CD4<br>0 | MGVLLTQRTL LSLVLALLFP SMASMEVQLV ESGGGLVQPG GSLRLSCAAS<br>GFNIKDTYMH WVRQAPGKGL EWVARIDPAN GNSKYADSVK GRFTISADTS<br>KNTAYLQMNS LRAEDTAVYY CAPFGYYVSD YAMAYWGQGT LVTVSSGGGG<br>SGGGGSGGGG SDIQLTQSPS SLSASVGDRV TITCRAGESV DIFGVGFLHW<br>YQQKPGKAPK LLIYRASNLE SGVPSRFSGS GSRTDFTLTI SSLQPEDFAT<br>YYCQQTNEDP YTFGQGTKVE IKAAAGSGGS GFWVLVVVGG VLACYSLLVT<br>VAFIIFWVRS KRSRLLHSDY MNMTPRRPGP TRKHYQPYAP PRDFAAYRSK<br>KVAKKPTNKA PHPKQEPQEI NFPDDLPGSN TAAPVQETLH GCQPVTQEDG<br>KESRISVQER Q |
| 145 | CD8a_HuT8<br>4.66<br>_CD28TM<br>_CD28_CD4<br>0 | MALPVTALLL PLALLLHAAR PEVQLVESGG GLVQPGGSLR LSCAASGFNI<br>KDTYMHWVRQ APGKGLEWVA RIDPANGNSK YADSVKGRFT ISADTSKNTA<br>YLQMNSLRAE DTAVYYCAPF GYYVSDYAMA YWGQGTLVTV SSGGGGSGGG<br>GSGGGGSDIQ LTQSPSSLSA SVGDRVTITC RAGESVDIFG VGFLHWYQQK<br>PGKAPKLLIY RASNLESGVP SRFSGSGSRT DFTLTISSLQ PEDFATYYCQ<br>QTNEDPYTFG QGTKVEIKAA AGSGGSGFWV LVVVGGVLAC YSLLVTVAFI<br>IFWVRSKRSR LLHSDYMNMT PRRPGPTRKH YQPYAPPRDF AAYRSKKVAK<br>KPTNKAPHPK QEPQEINFPD DLPGSNTAAP VQETLHGCQP VTQEDGKESR<br>ISVQERQ |
| 146 | CD2_HuT84<br>.66<br>_CD28TM<br>_CD28_CD4<br>0 | MSFPCKFVAS FLLIFNVSSK GAVSEVQLVE SGGGLVQPGG SLRLSCAASG<br>FNIKDTYMHW VRQAPGKGLE WVARIDPANG NSKYADSVKG RFTISADTSK<br>NTAYLQMNSL RAEDTAVYYC APFGYYVSDY AMAYWGQGTL VTVSSGGGGS<br>GGGGSGGGGS DIQLTQSPSS LSASVGDRVT ITCRAGESVD IFGVGFLHWY<br>QQKPGKAPKL LIYRASNLES GVPSRFSGSG SRTDFTLTIS SLQPEDFATY<br>YCQQTNEDPY TFGQGTKVEI KAAAGSGGSG FWVLVVVGGV LACYSLLVTV<br>AFIIFWVRSK RSRLLHSDYM NMTPRRPGPT RKHYQPYAPP RDFAAYRSKK<br>VAKKPTNKAP HPKQEPQEIN FPDDLPGSNT AAPVQETLHG CQPVTQEDGK<br>ESRISVQERQ |
| 147 | IL2_HuT84<br>.66<br>_CD28TM<br>_CD28_CD4<br>0 | MYRMQLLSCI ALSLALVTNS EVQLVESGGG LVQPGGSLRL SCAASGFNIK<br>DTYMHWVRQA PGKGLEWVAR IDPANGNSKY ADSVKGRFTI SADTSKNTAY<br>LQMNSLRAED TAVYYCAPFG YYVSDYAMAY WGQGTLVTVS SGGGGSGGGG<br>SGGGGSDIQL TQSPSSLSAS VGDRVTITCR AGESVDIFGV GFLHWYQQKP<br>GKAPKLLIYR ASNLESGVPS RFSGSGSRTD FTLTISSLQP EDFATYYCQQ<br>TNEDPYTFGQ GTKVEIKAAA GSGGSGFWVL VVVGGVLACY SLLVTVAFII<br>FWVRSKRSRL LHSDYMNMTP RRPGPTRKHY QPYAPPRDFA AYRSKKVAKK<br>PTNKAPHPKQ EPQEINFPDD LPGSNTAAPV QETLHGCQPV TQEDGKESRI<br>SVQERQ |
| 148 | GM-CSF_HuT84<br>.66<br>_CD28TM<br>_CD28_CD4<br>0 | MWLQSLLLLG TVACSISEVQ LVESGGGLVQ PGGSLRLSCA ASGFNIKDTY<br>MHWVRQAPGK GLEWVARIDP ANGNSKYADS VKGRFTISAD TSKNTAYLQM<br>NSLRAEDTAV YYCAPFGYYV SDYAMAYWGQ GTLVTVSSGG GGSGGGGSGG<br>GGSDIQLTQS PSSLSASVGD RVTITCRAGE SVDIFGVGFL HWYQQKPGKA<br>PKLLIYRASN LESGVPSRFS GSGSRTDFTL TISSLQPEDF ATYYCQQTNE<br>DPYTFGQGTK VEIKAAAGSG GSGFWVLVVV GGVLACYSLL VTVAFIIFWV |

TABLE 7-continued

Amino Acid Sequences

| ID No | Component | Sequence |
|---|---|---|
| | | RSKRSRLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |
| 149 | hIgGk-VIII_HuT84.66_CD28TM_CD28_CD4 0 | MEAPAQLLFL LLLWLPDTTR EVQLVESGGG LVQPGGSLRL SCAASGFNIK DTYMHWVRQA PGKGLEWVAR IDPANGNSKY ADSVKGRFTI SADTSKNTAY LQMNSLRAED TAVYYCAPFG YYVSDYAMAY WGQGTLVTVS SGGGGSGGGG SGGGGSDIQL TQSPSSLSAS VGDRVTITCR AGESVDIFGV GFLHWYQQKP GKAPKLLIYR ASNLESGVPS RFSGSGSRTD FTLTISSLQP EDFATYYCQQ TNEDPYTFGQ GTKVEIKAAA GSGGGSGFWVL VVVGGVLACY SLLVTVAFII FWVRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 150 | OSM_MFE23_spCD28 (trun)_CD28_CD4 0 | MGVLLTQRTL LSLVLALLFP SMASMQVKLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGGSIIHV KGKHLCPSPL FPGPSKPFWV LVVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 151 | CD8a_MFE23_spCD28 (trun)_CD28_CD4 0 | MALPVTALLL PLALLLHAAR PQVKLQQSGA ELVRSGTSVK LSCTASGFNI KDSYMHWLRQ GPEQGLEWIG WIDPENGDTE YAPKFQGKAT FTTDTSSNTA YLQLSSLTSE DTAVYYCNEG TPTGPYYFDY WGQGTTVTVS SGGGGSGGGG SGGGGSENVL TQSPAIMSAS PGEKVTITCS ASSSVSYMHW FQQKPGTSPK LWIYSTSNLA SGVPARFSGS GSGTSYSLTI SRMEAEDAAT YYCQQRSSYP LTFGAGTKLE LKRAAAGSGG SGIIHVKGKH LCPSPLFPGP SKPFWVLVVV GGVLACYSLL VTVAFIIFWV RSKRSLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |
| 152 | CD2_MFE23_spCD28 (trun)_CD28_CD4 0 | MSFPCKFVAS FLLIFNVSSK GAVSQVKLQQ SGAELVRSGT SVKLSCTASG FNIKDSYMHW LRQGPEQGLE WIGWIDPENG DTEYAPKFQG KATFTTDTSS NTAYLQLSSL TSEDTAVYYC NEGTPTGPYY FDYWGQGTTV TVSSGGGGSG GGGSGGGGSE NVLTQSPAIM SASPGEKVTI TCSASSSVSY MHWFQQKPGT SPKLWIYSTS NLASGVPARF SGSGSGTSYS LTISRMEAED AATYYCQQRS SYPLTFGAGT KLELKRAAAG SGGSGIIHVK GKHLCPSPLF PGPSKPFWVL VVVGGVLACY SLLVTVAFII FWVRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 153 | IL2_MFE23_spCD28 (trun)_CD28_CD4 0 | MYRMQLLSCI ALSLALVTNS QVKLQQSGAE LVRSGTSVKL SCTASGFNIK DSYMHWLRQG PEQGLEWIGW IDPENGDTEY APKFQGKATF TTDTSSNTAY LQLSSLTSED TAVYYCNEGT PTGPYYFDYW GQGTTVTVSS GGGGSGGGGS GGGGSENVLT QSPAIMSASP GEKVTITCSA SSSVSYMHWF QQKPGTSPKL WIYSTSNLAS GVPARFSGSG SGTSYSLTIS RMEAEDAATY YCQQRSSYPL TFGAGTKLEL KRAAAGSGGS GIIHVKGKHL CPSPLFPGPS KPFWVLVVVG GVLACYSLLV TVAFIIFWVR SKRSLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 154 | GM-CSF_MFE23_spCD28 (trun)_CD28_CD4 0 | MWLQSLLLLG TVACSISQVK LQQSGAELVR SGTSVKLSCT ASGFNIKDSY MHWLRQGPEQ GLEWIGWIDP ENGDTEYAPK FQGKATFTTD TSSNTAYLQL SSLTSEDTAV YYCNEGTPTG PYYFDYWGQG TTVTVSSGGG GSGGGGSGGG GSENVLTQSP AIMSASPGEK VTITCSASSS VSYMHWFQQK PGTSPKLWIY STSNLASGVP ARFSGSGSGT SYSLTISRME AEDAATYYCQ QRSSYPLTFG AGTKLELKRA AAGSGGSGII HVKGKHLCPS PLFPGPSKPF WVLVVVGGVL ACYSLLVTVA FIIFWVRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |
| 155 | hIgGk-VIII_MFE23_spCD28 (trun)_CD28_CD4 0 | MEAPAQLLFL LLLWLPDTTR QVKLQQSGAE LVRSGTSVKL SCTASGFNIK DSYMHWLRQG PEQGLEWIGW IDPENGDTEY APKFQGKATF TTDTSSNTAY LQLSSLTSED TAVYYCNEGT PTGPYYFDYW GQGTTVTVSS GGGGSGGGGS GGGGSENVLT QSPAIMSASP GEKVTITCSA SSSVSYMHWF QQKPGTSPKL WIYSTSNLAS GVPARFSGSG SGTSYSLTIS RMEAEDAATY YCQQRSSYPL TFGAGTKLEL KRAAAGSGGS GIIHVKGKHL CPSPLFPGPS KPFWVLVVVG GVLACYSLLV TVAFIIFWVR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |

TABLE 7-continued

Amino Acid Sequences

| ID No | Component | Sequence |
|---|---|---|
| 156 | OSM_MFE23_ spCD28 (trun) _CD28_CD4 0 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGSGIIHV KGKHLCPSPL FPGPSKPFWV LVVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 157 | CD8a_ MFE23 (K > Q) _spCD28 (trun) _CD28_CD4 0 | MALPVTALLL PLALLLHAAR PQVQLQQSGA ELVRSGTSVK LSCTASGFNI KDSYMHWLRQ GPEQGLEWIG WIDPENGDTE YAPKFQGKAT FTTDTSSNTA YLQLSSLTSE DTAVYYCNEG TPTGPYYFDY WGQGTTVTVS SGGGGSGGGG SGGGGSENVL TQSPAIMSAS PGEKVTITCS ASSSVSYMHW FQQKPGTSPK LWIYSTSNLA SGVPARFSGS GSGTSYSLTI SRMEAEDAAT YYCQQRSSYP LTFGAGTKLE LKRAAAGSGG SGIIHVKGKH LCPSPLFPGP SKPFWVLVVV GGVLACYSLL VTVAFIIFWV RSKRSLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |
| 158 | CD2_MFE23 (K > Q) _spCD28 (trun) _CD28_CD4 0 | MSFPCKFVAS FLLIFNVSSK GAVSQVQLQQ SGAELVRSGT SVKLSCTASG FNIKDSYMHW LRQGPEQGLE WIGWIDPENG DTEYAPKFQG KATFTTDTSS NTAYLQLSSL TSEDTAVYYC NEGTPTGPYY FDYWGQGTTV TVSSGGGGSG GGGSGGGGSE NVLTQSPAIM SASPGEKVTI TCSASSSVSY MHWFQQKPGT SPKLWIYSTS NLASGVPARF SGSGSGTSYS LTISRMEAED AATYYCQQRS SYPLTFGAGT KLELKRAAAG SGGSGIIHVK GKHLCPSPLF PGPSKPFWVL VVVGGVLACY SLLVTVAFII FWVRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 159 | IL2_MFE23 (K > Q) _spCD28 (trun) _CD28_CD4 0 | MYRMQLLSCI ALSLALVTNS QVQLQQSGAE LVRSGTSVKL SCTASGFNIK DSYMHWLRQG PEQGLEWIGW IDPENGDTEY APKFQGKATF TTDTSSNTAY LQLSSLTSED TAVYYCNEGT PTGPYYFDYW GQGTTVTVSS GGGGSGGGGS GGGGSENVLT QSPAIMSASP GEKVTITCSA SSSVSYMHWF QQKPGTSPKL WIYSTSNLAS GVPARFSGSG SGTSYSLTIS RMEAEDAATY YCQQRSSYPL TFGAGTKLEL KRAAAGSGGS GIIHVKGKHL CPSPLFPGPS KPFWVLVVVG GVLACYSLLV TVAFIIFWVR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 160 | GM-CSF_ MFE23 (K > Q) _spCD28 (trun) _CD28_CD4 0 | MWLQSLLLLG TVACSISQVQ LQQSGAELVR SGTSVKLSCT ASGFNIKDSY MHWLRQGPEQ GLEWIGWIDP ENGDTEYAPK FQGKATFTTD TSSNTAYLQL SSLTSEDTAV YYCNEGTPTG PYYFDYWGQG TTVTVSSGGG GSGGGGSGGG GSENVLTQSP AIMSASPGEK VTITCSASSS VSYMHWFQQK PGTSPKLWIY STSNLASGVP ARFSGSGSGT SYSLTISRME AEDAATYYCQ QRSSYPLTFG AGTKLELKRA AAGSGGSGII HVKGKHLCPS PLFPGPSKPF WVLVVVGGVL ACYSLLVTVA FIIFWVRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |
| 161 | hIgGk- VIII _MFE23 (K > Q) _spCD28 (trun) _CD28_CD4 0 | MEAPAQLLFL LLLWLPDTTR QVQLQQSGAE LVRSGTSVKL SCTASGFNIK DSYMHWLRQG PEQGLEWIGW IDPENGDTEY APKFQGKATF TTDTSSNTAY LQLSSLTSED TAVYYCNEGT PTGPYYFDYW GQGTTVTVSS GGGGSGGGGS GGGGSENVLT QSPAIMSASP GEKVTITCSA SSSVSYMHWF QQKPGTSPKL WIYSTSNLAS GVPARFSGSG SGTSYSLTIS RMEAEDAATY YCQQRSSYPL TFGAGTKLEL KRAAAGSGGS GIIHVKGKHL CPSPLFPGPS KPFWVLVVVG GVLACYSLLV TVAFIIFWVR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 162 | OSM_HuMFE 23 _spCD28 (trun) _CD28_CD4 0 CTP244 | MGVLLTQRTL LSLVLALLFP SMASMQVKLE QSGAEVVKPG ASVKLSCKAS GFNIKDSYMH WLRQGPGQRL EWIGWIDPEN GDTEYAPKFQ GKATFTTDTS ANTAYLGLSS LRPEDTAVYY CNEGTPTGPY YFDYWGQGTL VTVSSGGGGS GGGGSGGGGS ENVLTQSPSS MSASVGDRVN IACSASSSVS YMHWFQQKPG KSPKLWIYST SNLASGVPSR FSGSGSGTDY SLTISSMQPE DAATYYCQQR SSYPLTFGGG TKLEIKAAAG SGGSGIIHVK GKHLCPSPLF PGPSKPFWVL VVVGGVLACY SLLVTVAFII FWVRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 163 | CD8a_HuMF E23 _spCD28 (trun) | MALPVTALLL PLALLLHAAR PQVKLEQSGA EVVKPGASVK LSCKASGFNI KDSYMHWLRQ GPGQRLEWIG WIDPENGDTE YAPKFQGKAT FTTDTSANTA YLGLSSLRPE DTAVYYCNEG TPTGPYYFDY WGQGTLVTVS SGGGGSGGGG SGGGGSENVL TQSPSSMSAS VGDRVNIACS ASSSVSYMHW FQQKPGKSPK |

TABLE 7-continued

Amino Acid Sequences

| ID No | Component | Sequence |
|---|---|---|
| | _CD28_CD4 0 | LWIYSTSNLA SGVPSRFSGS GSGTDYSLTI SSMQPEDAAT YYCQQRSSYP LTFGGGTKLE IKAAAGSGGS GIIHVKGKHL CPSPLFPGPS KPFWVLVVVG GVLACYSLLV TVAFIIFWVR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 164 | CD2_HuMFE23 _spCD28 (trun) _CD28_CD4 0 | MSFPCKFVAS FLLIFNVSSK GAVSQVKLEQ SGAEVVKPGA SVKLSCKASG FNIKDSYMHW LRQGPGQRLE WIGWIDPENG DTEYAPKFQG KATFTTDTSA NTAYLGLSSL RPEDTAVYYC NEGTPTGPYY FDYWGQGTLV TVSSGGGGSG GGGSGGGGSE NVLTQSPSSM SASVGDRVNI ACSASSSVSY MHWFQQKPGK SPKLWIYSTS NLASGVPSRF SGSGSGTDYS LTISSMQPED AATYYCQQRS SYPLTFGGGT KLEIKAAAGS GGSGIIHVKG KHLCPSPLFP GPSKPFWVLV VVGGVLACYS LLVTVAFIIF WVRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 165 | IL2_HuMFE23 _spCD28 (trun) _CD28_CD4 0 | MYRMQLLSCI ALSLALVTNS QVKLEQSGAE VVKPGASVKL SCKASGFNIK DSYMHWLRQG PGQRLEWIGW IDPENGDTEY APKFQGKATF TTDTSANTAY LGLSSLRPED TAVYYCNEGT PTGPYYFDYW GQGTLVTVSS GGGGSGGGGS GGGGSENVLT QSPSSMSASV GDRVNIACSA SSSVSYMHWF QQKPGKSPKL WIYSTSNLAS GVPSRFSGSG SGTDYSLTIS SMQPEDAATY YCQQRSSYPL TFGGGTKLEI KAAAGSGGSG IIHVKGKHLC PSPLFPGPSK PFWVLVVVGG VLACYSLLVT VAFIIFWVRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 166 | GM-CSF_HuMFE23 _spCD28 (trun) _CD28_CD4 0 | MWLQSLLLLG TVACSISQVK LEQSGAEVVK PGASVKLSCK ASGFNIKDSY MHWLRQGPGQ RLEWIGWIDP ENGDTEYAPK FQGKATFTTD TSANTAYLGL SSLRPEDTAV YYCNEGTPTG PYYFDYWGQG TLVTVSSGGG GSGGGGSGGG GSENVLTQSP SSMSASVGDR VNIACSASSS VSYMHWFQQK PGKSPKLWIY STSNLASGVP SRFSGSGSGT DYSLTISSMQ PEDAATYYCQ QRSSYPLTFG GGTKLEIKAA AGSGGSGIIH VKGKHLCPSP LFPGPSKPFW VLVVVGGVLA CYSLLVTVAF IIFWVRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 167 | hIgGk-VIII _HuMFE23 _spCD28 (trun) _CD28_CD4 0 | MEAPAQLLFL LLLWLPDTTR QVKLEQSGAE VVKPGASVKL SCKASGFNIK DSYMHWLRQG PGQRLEWIGW IDPENGDTEY APKFQGKATF TTDTSANTAY LGLSSLRPED TAVYYCNEGT PTGPYYFDYW GQGTLVTVSS GGGGSGGGGS GGGGSENVLT QSPSSMSASV GDRVNIACSA SSSVSYMHWF QQKPGKSPKL WIYSTSNLAS GVPSRFSGSG SGTDYSLTIS SMQPEDAATY YCQQRSSYPL TFGGGTKLEI KAAAGSGGSG IIHVKGKHLC PSPLFPGPSK PFWVLVVVGG VLACYSLLVT VAFIIFWVRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 168 | OSM_CEA6 _spCD28 (trun) _CD28_CD4 0 | MGVLLTQRTL LSLVLALLFP SMASMQVQLV QSGAEVKKPG SSVKVSCKAS GGTFSNSPIN WLRQAPGQGL EWMGSIIPSF GTANYAQKFQ GRLTITADES TSTAYMELSS LRSEDTAVYY CAGRSHNYEL YYYYMDVWGQ GTMVTVSSGG GGSGGGGSGG GGSDIQMTQS PSTLSASIGD RVTITCRASE GIYHWLAWYQ QKPGKAPKLL IYKASSLASG APSRFSGSGS GTDFTLTISS LQPDDFATYY CQQYSNYPLT FGGGTKLEIK RAAAGSGGSG IIHVKGKHLC PSPLFPGPSK PFWVLVVVGG VLACYSLLVT VAFIIFWVRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 169 | CD8a_CEA6 _spCD28 (trun) _CD28_CD4 0 | MALPVTALLL PLALLLHAAR PQVQLVQSGA EVKKPGSSVK VSCKASGGTF SNSPINWLRQ APGQGLEWMG SIIPSFGTAN YAQKFQGRLT ITADESTSTA YMELSSLRSE DTAVYYCAGR SHNYELYYYY MDVWGQGTMV TVSSGGGGSG GGGSGGGGSD IQMTQSPSTL SASIGDRVTI TCRASEGIYH WLAWYQQKPG KAPKLLIYKA SSLASGAPSR FSGSGSGTDF TLTISSLQPD DFATYYCQQY SNYPLTFGGG TKLEIKRAAA GSGGSGIIHV KGKHLCPSPL FPGPSKPFWV LVVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 170 | CD2_CEA6 _spCD28 (trun) _CD28_CD4 0 | MSFPCKFVAS FLLIFNVSSK GAVSQVQLVQ SGAEVKKPGS SVKVSCKASG GTFSNSPINW LRQAPGQGLE WMGSIIPSFG TANYAQKFQG RLTITADEST STAYMELSSL RSEDTAVYYC AGRSHNYELY YYYMDVWGQG TMVTVSSGGG GSGGGGSGGG GSDIQMTQSP STLSASIGDR VTITCRASEG IYHWLAWYQQ KPGKAPKLLI YKASSLASGA PSRFSGSGSG TDFTLTISSL QPDDFATYYC QQYSNYPLTF GGGTKLEIKA AAGSGGSGII HVKGKHLCPS PLFPGPSKPF WVLVVVGGVL ACYSLLVTVA FIIFWVRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |

TABLE 7-continued

Amino Acid Sequences

| ID No | Component | Sequence |
|---|---|---|
| 171 | IL2_CEA6_spCD28 (trun)_CD28_CD4 0 | MYRMQLLSCI ALSLALVTNS QVQLVQSGAE VKKPGSSVKV SCKASGGTFS NSPINWLRQA PGQGLEWMGS IIPSFGTANY AQKFQGRLTI TADESTSTAY MELSSLRSED TAVYYCAGRS HNYELYYYYM DVWGQGTMVT VSSGGGGSGG GGSGGGGSDI QMTQSPSTLS ASIGDRVTIT CRASEGIYHW LAWYQQKPGK APKLLIYKAS SLASGAPSRF SGSGSGTDFT LTISSLQPDD FATYYCQQYS NYPLTFGGGT KLEIKRAAAG SGGSGIIHVK GKHLCPSPLF PGPSKPFWVL VVVGGVLACY SLLVTVAFII FWVRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 172 | GM-CSF_CEA6_spCD28 (trun)_CD28_CD4 0 | MWLQSLLLLG TVACSISQVQ LVQSGAEVKK PGSSVKVSCK ASGGTFSNSP INWLRQAPGQ GLEWMGSIIP SFGTANYAQK FQGRLTITAD ESTSTAYMEL SSLRSEDTAV YYCAGRSHNY ELYYYYMDVW GQGTMVTVSS GGGGSGGGGS GGGGSDIQMT QSPSTLSASI GDRVTITCRA SEGIYHWLAW YQQKPGKAPK LLIYKASSLA SGAPSRFSGS GSGTDFTLTI SSLQPDDFAT YYCQQYSNYP LTFGGGTKLE IKRAAAGSGG SGIIHVKGKH LCPSPLFPGP SKPFWVLVVV GGVLACYSLL VTVAFIIFWV RSKRSLLHS DYMNMTPRPR GPTRKHYQPY APPRDFAAYR SKKVAKKPTN KAPHPKQEPQ EINFPDDLPG SNTAAPVQET LHGCQPVTQE DGKESRISVQ ERQ |
| 173 | hIgGk-VIII_CEA6_spCD28 (trun)_CD28_CD4 0 | MEAPAQLLFL LLLWLPDTTR QVQLVQSGAE VKKPGSSVKV SCKASGGTFS NSPINWLRQA PGQGLEWMGS IIPSFGTANY AQKFQGRLTI TADESTSTAY MELSSLRSED TAVYYCAGRS HNYELYYYYM DVWGQGTMVT VSSGGGGSGG GGSGGGGSDI QMTQSPSTLS ASIGDRVTIT CRASEGIYHW LAWYQQKPGK APKLLIYKAS SLASGAPSRF SGSGSGTDFT LTISSLQPDD FATYYCQQYS NYPLTFGGGT KLEIKRAAAG SGGSGIIHVK GKHLCPSPLF PGPSKPFWVL VVVGGVLACY SLLVTVAFII FWVRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 174 | OSM_BW431/26_spCD28 (trun)_CD28_CD4 0 | MGVLLTQRTL LSLVLALLFP SMASMQLQES GPGLVRPSQT LSLTCTVSGF TISSGYSWHW VRQPPGRGLE WIGYIQYSGI TNYNPSLKSR VTMLVDTSKN QFSLRLSSVT AADTAVYYCA REDYDYHWYF DVWGQGSLVT VSSGGGGSGG GGSGGGGSGV HSDIQMTQSP SSLSASVGDR VTITCSTSSS VSYMHWYQQK PGKAPKLLIY STSNLASGVP SRFSGSGSGT DFTFTISSLQ PEDIATYYCH QWSSYPTFGQ GTKVEIKRAA AGSGGSGIIH VKGKHLCPSP LFPGPSKPFW VLVVVGGVLA CYSLLVTVAF IIFWVRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 175 | CD8a_BW431/26_spCD28 (trun)_CD28_CD4 0 | MALPVTALLL PLALLLHAAR PQLQESGPGL VRPSQTLSLT CTVSGFTISS GYSWHWVRQP PGRGLEWIGY IQYSGITNYN PSLKSRVTML VDTSKNQFSL RLSSVTAADT AVYYCAREDY DYHWYFDVWG QGSLVTVSSG GGGSGGGGSG GGGSGVHSDI QMTQSPSSLS ASVGDRVTIT CSTSSSVSYM HWYQQKPGKA PKLLIYSTSN LASGVPSRFS GSGSGTDFTF TISSLQPEDI ATYYCHQWSS YPTFGQGTKV EIKRAAAGSG GSGIIHVKGK HLCPSPLFPG PSKPFWVLVV VGGVLACYSL LVTVAFIIFW VRSKRSLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |
| 176 | CD2_BW431/26_spCD28 (trun)_CD28_CD4 0 | MSFPCKFVAS FLLIFNVSSK GAVSQLQESG PGLVRPSQTL SLTCTVSGFT ISSGYSWHWV RQPPGRGLEW IGYIQYSGIT NYNPSLKSRV TMLVDTSKNQ FSLRLSSVTA ADTAVYYCAR EDYDYHWYFD VWGQGSLVTV SSGGGGSGGG GSGGGGSGVH SDIQMTQSPS SLSASVGDRV TITCSTSSSV SYMHWYQQKP GKAPKLLIYS TSNLASGVPS RFSGSGSGTD FTFTISSLQP EDIATYYCHQ WSSYPTFGQG TKVEIKRAAA GSGGSGIIHV KGKHLCPSPL FPGPSKPFWV LVVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 177 | IL2_BW431/26_spCD28 (trun)_CD28_CD4 0 | MYRMQLLSCI ALSLALVTNS QLQESGPGLV RPSQTLSLTC TVSGFTISSG YSWHWVRQPP GRGLEWIGYI QYSGITNYNP SLKSRVTMLV DTSKNQFSLR LSSVTAADTA VYYCAREDYD YHWYFDVWGQ GSLVTVSSGG GGSGGGGSGG GGSGVHSDIQ MTQSPSSLSA SVGDRVTITC STSSSVSYMH WYQQKPGKAP KLLIYSTSNL ASGVPSRFSG SGSGTDFTFT ISSLQPEDIA TYYCHQWSSY PTFGQGTKVE IKRAAAGSGG SGIIHVKGKH LCPSPLFPGP SKPFWVLVVV GGVLACYSLL VTVAFIIFWV RSKRSLLHS DYMNMTPRPR GPTRKHYQPY APPRDFAAYR SKKVAKKPTN KAPHPKQEPQ EINFPDDLPG SNTAAPVQET LHGCQPVTQE DGKESRISVQ ERQ |
| 178 | GM-CSF_BW431/26_spCD28 (trun) | MWLQSLLLLG TVACSISQLQ ESGPGLVRPS QTLSLTCTVS GFTISSGYSW HWVRQPPGRG LEWIGYIQYS GITNYNPSLK SRVTMLVDTS KNQFSLRLSS VTAADTAVYY CAREDYDYHW YFDVWGQGSL VTVSSGGGGS GGGGSGGGGS GVHSDIQMTQ SPSSLSASVG DRVTITCSTS SSVSYMHWYQ QKPGKAPKLL |

TABLE 7-continued

Amino Acid Sequences

| ID No | Component | Sequence |
|---|---|---|
| | _CD28_CD4 0 | IYSTSNLASG VPSRFSGSGS GTDFTFTISS LQPEDIATYY CHQWSSYPTF GQGTKVEIKR AAAGSGGSGI IHVKGKHLCP SPLFPGPSKP FWVLVVVGGV LACYSLLVTV AFIIFWVRSK RSRLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |
| 179 | hIgGk-VIII_BW431/26_spCD28(trun)_CD28_CD4 0 | MEAPAQLLFL LLLWLPDTTR QLQESGPGLV RPSQTLSLTC TVSGFTISSG YSWHWVRQPP GRGLEWIGYI QYSGITNYNP SLKSRVTMLV DTSKNQFSLR LSSVTAADTA VYYCAREDYD YHWYFDVWGQ GSLVTVSSGG GGSGGGGSGG GGSGVHSDIQ MTQSPSSLSA SVGDRVTITC STSSSVSYMH WYQQKPGKAP KLLIYSTSNL ASGVPSRFSG SGSGTDFTFT ISSLQPEDIA TYYCHQWSSY PTFGQGTKVE IKRAAAGSGG SGIIHVKGKH LCPSPLFPGP SKPFWVLVVV GGVLACYSLL VTVAFIIFWV RSKRSLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |
| 180 | OSM_HuT84.66_spCD28(trun)_CD28_CD4 0 | MGVLLTQRTL LSLVLALLFP SMASMEVQLV ESGGGLVQPG GSLRLSCAAS GFNIKDTYMH WVRQAPGKGL EWVARIDPAN GNSKYADSVK GRFTISADTS KNTAYLQMNS LRAEDTAVYY CAPFGYYVSD YAMAYWGQGT LVTVSSGGGG SGGGGSGGGG SDIQLTQSPS SLSASVGDRV TITCRAGESV DIFGVGFLHW YQQKPGKAPK LLIYRASNLE SGVPSRFSGS GSRTDFTLTI SSLQPEDFAT YYCQQTNEDP YTPGQGTKVE IKAAAGSGGS GIIHVKGKHL CPSPLFPGPS KPFWVLVVVG GVLACYSLLV TVAFIIFWVR SKRSLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 181 | CD8a_HuT84.66_spCD28(trun)_CD28_CD4 0 | MALPVTALLL PLALLLHAAR PEVQLVESGG GLVQPGGSLR LSCAASGFNI KDTYMHWVRQ APGKGLEWVA RIDPANGNSK YADSVKGRFT ISADTSKNTA YLQMNSLRAE DTAVYYCAPF GYYVSDYAMA YWGQGTLVTV SSGGGGSGGG GSGGGGSDIQ LTQSPSSLSA SVGDRVTITC RAGESVDIFG VGFLHWYQQK PGKAPKLLIY RASNLESGVP SRFSGSGSRT DFTLTISSLQ PEDFATYYCQ QTNEDPYTFG QGTKVEIKAA AGSGGSGIIH VKGKHLCPSP LFPGPSKPFW VLVVVGGVLA CYSLLVTVAF IIFWVRSKRS LLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 182 | CD2_HuT84.66_spCD28(trun)_CD28_CD4 0 | MSFPCKFVAS FLLIFNVSSK GAVSEVQLVE SGGGLVQPGG SLRLSCAASG FNIKDTYMHW VRQAPGKGLE WVARIDPANG NSKYADSVKG RFTISADTSK NTAYLQMNSL RAEDTAVYYC APFGYYVSDY AMAYWGQGTL VTVSSGGGGS GGGGSGGGGS DIQLTQSPSS LSASVGDRVT ITCRAGESVD IFGVGFLHWY QQKPGKAPKL LIYRASNLES GVPSRFSGSG SRTDFTLTIS SLQPEDFATY YCQQTNEDPY TFGQGTKVEI KAAAGSGGSG IIHVKGKHLC PSPLFPGPSK PFWVLVVVGG VLACYSLLVT VAFIIFWVRS KRSLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 183 | IL2_HuT84.66_spCD28(trun)_CD28_CD4 0 | MYRMQLLSCI ALSLALVTNS EVQLVESGGG LVQPGGSLRL SCAASGFNIK DTYMHWVRQA PGKGLEWVAR IDPANGNSKY ADSVKGRFTI SADTSKNTAY LQMNSLRAED TAVYYCAPFG YYVSDYAMAY WGQGTLVTVS SGGGGSGGGG SGGGGSDIQL TQSPSSLSAS VGDRVTITCR AGESVDIFGV GFLHWYQQKP GKAPKLLIYR ASNLESGVPS RFSGSGSRTD FTLTISSLQP EDFATYYCQQ TNEDPYTFGQ GTKVEIKAAA GSGGSGIIHV KGKHLCPSPL FPGPSKPFWV LVVVGGVLAC YSLLVTVAFI IFWVRSKRS LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 184 | GM-CSF_HuT84.66_spCD28(trun)_CD28_CD4 0 | MWLQSLLLLG TVACSISEVQ LVESGGGLVQ PGGSLRLSCA ASGFNIKDTY MHWVRQAPGK GLEWVARIDP ANGNSKYADS VKGRFTISAD TSKNTAYLQM NSLRAEDTAV YYCAPFGYYV SDYAMAYWGQ GTLVTVSSGG GGSGGGGSGG GGSDIQLTQS PSSLSASVGD RVTITCRAGE SVDIFGVGFL HWYQQKPGKA PKLLIYRASN LESGVPSRFS GSGSRTDFTL TISSLQPEDF ATYYCQQTNE DPYTFGQGTK VEIKAAAGSG GSGIIHVKGK HLCPSPLFPG PSKPFWVLVV VGGVLACYSL LVTVAFIIFW VRSKRSLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |
| 185 | hIgGk-VIII_HuT84.66_spCD28(trun)_CD28_CD4 0 | MEAPAQLLFL LLLWLPDTTR EVQLVESGGG LVQPGGSLRL SCAASGFNIK DTYMHWVRQA PGKGLEWVAR IDPANGNSKY ADSVKGRFTI SADTSKNTAY LQMNSLRAED TAVYYCAPFG YYVSDYAMAY WGQGTLVTVS SGGGGSGGGG SGGGGSDIQL TQSPSSLSAS VGDRVTITCR AGESVDIFGV GFLHWYQQKP GKAPKLLIYR ASNLESGVPS RFSGSGSRTD FTLTISSLQP EDFATYYCQQ TNEDPYTFGQ GTKVEIKAAA GSGGSGIIHV KGKHLCPSPL FPGPSKPFWV LVVVGGVLAC YSLLVTVAFI IFWVRSKRS LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |

TABLE 7-continued

Amino Acid Sequences

| ID No | Component | Sequence |
|---|---|---|
| 186 | SS1 | QVQLQQSGPE LEKPGASVKL SCKASGYSFT GYTMNWVKQS HGKSLEWIGL ITPYNGASSY NQKFRGKATL TVDKSSSTAY MDLLSLTSED SAVYFCARGG YDGRGFDYWG QGTTVTVSSG GGGSGGGGSG GGGSDIELTQ SPAIMSASPG EKVTMTCSAS SSVSYMHWYQ QKSGTSPKRW IYDTSKLASG VPGRFSGSGS GNSYSLTISS VEAEDDATYY CQQWSKHPLT FGAGTKLEIK |
| 187 | M5 (humanised SS1) | QVQLVQSGAE VEKPGASVKV SCKASGYTFT DYYMHWVRQA PGQGLEWMGW INPNSGGTNY AQKFQGRVTM TRDTSISTAY MELSRLRSDD TAVYYCASGW DFDYWGQGTL VTVSSGGGGS GGGGSGGGGS DIVMTQSPSS LSASVGDRVT ITCRASQSIR YYLSWYQQKP GKAPKLLIYT ASILQNGVPS RFSGSGSGTD FTLTISSLQP EDFATYYCLQ TYTTPDFGPG TKVEIK |
| 188 | HN1 | QVQLVQSGAE VKRPGASVQV SCRASGYSIN TYYMQWVRQA PGAGLEWMGV INPSGVTSYA QKFQGRVTLT NDTSTNTVYM QLNSLTSADT AVYYCARWAL WGDFGMDVWG KGTLVTVSSG GGGSGGGGSG GGGSDIQMTQ SPSTLSASIG DRVTITCRAS EGIYHWLAWY QQKPGKAPKL LIYKASSLAS GAPSRFSGSG SGTDFTLTIS SLQPDDFATY YCQQYSNYPL TFGGGTKLEI K |
| 189 | M912 | QVQLQESGPG LVKPSETLSL TCTVSGGSVS SGSYYWSWIR QPPGKGLEWI GYIYYSGSTN YNPSLKSRVT ISVDTSKNQF SLKLSSVTAA DTAVYYCARE GKNGAFDIWG QGTMVTVSSG GGGSGGGGSG GGGSDIQMTQ SPSSLSASVG DRVTITCRAS QSISSYLNWY QQKPGKAPKL LIYAASSLQS GVPSGFSGSG SGTDFTLTIS SLQPEDFATY YCQQSYSTPL TFGGGTKVEI K |
| 190 | HuYP218 | EVQLVESGGG LVQPGGSLRL SCAASGFDLG FYFYACWVRQ APGKGLEWVS CIYTAGSGST YYASWAKGRF TISRDNSKNT LYLQMNSLRA EDTAVYYCAR STANTRSTYY LNLWGQGTLV TVSSGGGGSG GGGGGGGSD IQMTQSPSSL SASVGDRVTI TCQASQRISS YLSWYQQKPG KVPKLLIYGA STLASGVPSR FSGSGSGTDF TLTISSLQPE DVATYYCQSY AYFDSNNWHA FGGGTKVEI |
| 191 | P4 | QVQLQQSGPG LVTPSQTLSL TCAISGDSVS SNSATWNWIR QSPSRGLEWL GRTYYRSKWY NDYAVSVKSR MSINPDTSKN QFSLQLNSVT PEDTAVYYCA RGMMTYYYGM DVWGQGTTVT VSSGGGGSGG GGSGGGGSQP VLTQSSSLSA SPGASASLTC TLRSGINVGP YRIYWYQQKP GSPPQYLLNY KSDSDKQQGS GVPSRFSGSK DASANAGVLL ISGLRSEDEA DYYCMIWHSS AAVFGGGTQL TVLS |
| 192 | OSM_SS1 _spCD28 _CD28_CD4 0 CTP224 | MGVLLTQRTL LSLVLALLFP SMASMQVQLQ QSGPELEKPG ASVKLSCKAS GYSFTGYTMN WVKQSHGKSL EWIGLITPYN GASSYNQKFR GKATLTVDKS SSTAYMDLLS LTSEDSAVYF CARGGYDGRG FDYWGQGTTV TVSSGGGGSG GGGSGGGGSD IELTQSPAIM SASPGEKVTM TCSASSSVSY MHWYQQKSGT SPKRWIYDTS KLASGVPGRF SGSGSGNSYS LTISSVEAED DATYYCQQWS KHPLTFGAGT KLEIKAAAGS GGGSGGGILV KQSPMLVAYD NAVNLSCKYS YNLFSREFRA SLHKGLDSAV EVCVVYGNYS QQLQVYSKTG FNCDGKLGNE SVTFYLQNLY VNQTDIYFCK IEVMYPPPYL DNEKSNGTII HVKGKHLCPS PLFPGPSKPF WVLVVVGGVL ACYSLLVTVA FIIFWVRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |
| 193 | CD8a_SS1 _spCD28 _CD28_CD4 0 | MALPVTALLL PLALLLHAAR PQVQLQQSGP ELEKPGASVK LSCKASGYSF TGYTMNWVKQ SHGKSLEWIG LITPYNGASS YNQKFRGKAT LTVDKSSSTA YMDLLSLTSE DSAVYFCARG GYDGRGFDYW GQGTTVTVSS GGGGSGGGGS GGGGSDIELT QSPAIMSASP GEKVTMTCSA SSSVSYMHWY QQKSGTSPKR WIYDTSKLAS GVPGRFSGSG SGNSYSLTIS SVEAEDDATY YCQQWSKHPL TFGAGTKLEI KAAAGSGGGS ILVKQSPMLV AYDNAVNLSC KYSYNLFSRE FRASLHKGLD SAVEVCVVYG NYSQQLQVYS KTGFNCDGKL GNESVTFYLQ NLYVNQTDIY FCKIEVMYPP PYLDNEKSNG TIIHVKGKHL CPSPLFPGPS KPFWVLVVVG GVLACYSLLV TVAFIIFWVR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 194 | CD2_SS1 _spCD28 _CD28_CD4 0 | MSFPCKFVAS FLLIFNVSSK GAVSQVQLQQ SGPELEKPGA SVKLSCKASG YSFTGYTMNW VKQSHGKSLE WIGLITPYNG ASSYNQKFRG KATLTVDKSS STAYMDLLSL TSEDSAVYFC ARGGYDGRGF DYWGQGTTVT VSSGGGGSGG GGSGGGGSDI ELTQSPAIMS ASPGEKVTMT CSASSSVSYM HWYQQKSGTS PKRWIYDTSK LASGVPGRFS GSGSGNSYSL TISSVEAEDD ATYYCQQWSK HPLTFGAGTK LEIKAAAGSG GSGILVKQSP MLVAYDNAVN LSCKYSYNLF SREFRASLHK GLDSAVEVCV VYGNYSQQLQ VYSKTGFNCD GKLGNESVTF YLQNLYVNQT DIYFCKIEVM YPPPYLDNEK SNGTIIHVKG KHLCPSPLFP GPSKPFWVLV VVGGVLACYS LLVTVAFIIF WVRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |

TABLE 7-continued

Amino Acid Sequences

| ID No | Component | Sequence |
|---|---|---|
| 195 | IL2_SS1_spCD28_CD4 0 | MYRMQLLSCI ALSLALVTNS QVQLQQSGPE LEKPGASVKL SCKASGYSFT GYTMNWVKQS HGKSLEWIGL ITPYNGASSY NQKFRGKATL TVDKSSSTAY MDLLSLTSED SAVYFCARGG YDGRGFDYWG QGTTVTVSSG GGGSGGGGSG GGGSDIELTQ SPAIMSASPG EKVTMTCSAS SSVSYMHWYQ QKSGTSPKRW IYDTSKLASG VPGRFSGSGS GNSYSLTISS VEAEDDATYY CQQWSKHPLT FGAGTKLEIK AAAGSGGSGI LVKQSPMLVA YDNAVNLSCK YSYNLFSREF RASLHKGLDS AVEVCVVYGN YSQQLQVYSK TGFNCDGKLG NESVTFYLQN LYVNQTDIYF CKIEVMYPPP YLDNEKSNGT IIHVKGKHLC PSPLFPGPSK PFWVLVVVGG VLACYSLLVT VAFIIFWVRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 196 | GM-CSF_SS1_spCD28_CD4 0 | MWLQSLLLLG TVACSISQVQ LQQSGPELEK PGASVKLSCK ASGYSETGYT MNWVKQSHGK SLEWIGLITP YNGASSYNQK FRGKATLTVD KSSSTAYMDL LSLTSEDSAV YFCARGGYDG RGFDYWGQGT TVTVSSGGGG SGGGGSGGGG SDIELTQSPA IMSASPGEKV TMTCSASSSV SYMHWYQQKS GTSPKRWIYD TSKLASGVPG RFSGSGSGNS YSLTISSVEA EDDATYYCQQ WSKHPLTFGA GTKLEIKAAA GSGGSGILVK QSPMLVAYDN AVNLSCKYSY NLFSREFRAS LHKGLDSAVE VCVVYGNYSQ QLQVYSKTGF NCDGKLGNES VTFYLQNLYV NQTDIYFCKI EVMYPPPYLD NEKSNGTIIH VKGKHLCPSP LFPGPSKPFW VLVVVGGVLA CYSLLVTVAF IIFWVRSKRS RLLHSDYMNM TPRRPGPTRK HYQPYAPPRD FAAYRSKKVA KKPTNKAHPP KQEPQEINFP DDLPGSNTAA PVQETLHGCQ PVTQEDGKES RISVQERQ |
| 197 | hIgGk-VIII_SS1_spCD28_CD4 0 | MEAPAQLLFL LLLWLPDTTR QVQLQQSGPE LEKPGASVKL SCKASGYSFT GYTMNWVKQS HGKSLEWIGL ITPYNGASSY NQKFRGKATL TVDKSSSTAY MDLLSLTSED SAVYFCARGG YDGRGFDYWG QGTTVTVSSG GGGSGGGGSG GGGSDIELTQ SPAIMSASPG EKVTMTCSAS SSVSYMHWYQ QKSGTSPKRW IYDTSKLASG VPGRFSGSGS GNSYSLTISS VEAEDDATYY CQQWSKHPLT FGAGTKLEIK AAAGSGGSGI LVKQSPMLVA YDNAVNLSCK YSYNLFSREF RASLHKGLDS AVEVCVVYGN YSQQLQVYSK TGFNCDGKLG NESVTFYLQN LYVNQTDIYF CKIEVMYPPP YLDNEKSNGT IIHVKGKHLC PSPLFPGPSK PFWVLVVVGG VLACYSLLVT VAFIIFWVRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 198 | OSM_SS1_spCD8_CD28_CD4 0_CTP236 | MGVLLTQRTL LSLVLALLFP SMASMQVQLQ QSGPELEKPG ASVKLSCKAS GYSFTGYTMN WVKQSHGKSL EWIGLITPYN GASSYNQKFR GKATLTVDKS SSTAYMDLLS LTSEDSAVYF CARGGYDGRG FDYWGQGTTV TVSSGGGGSG GGGSGGGGSD IELTQSPAIM SASPGEKVTM TCSASSSVSY MHWYQQKSGT SPKRWIYDTS KLASGVPGRF SGSGSGNSYS LTISSVEAED DATYYCQQWS KHPLTFGAGT KLEIKAAAGS GGSGFVPVFL PAKPTTTPAP RPPTPAPTIA SQPLSLRPEA CRPAAGGAVH TRGLDFACDI YIWAPLAGTC GVLLLSLVIT LYCNHRNRSK RSRLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |
| 199 | CD8a_SS1_spCD8_CD28_CD4 0 | MALPVTALLL PLALLLHAAR PQVQLQQSGP ELEKPGASVK LSCKASGYSF TGYTMNWVKQ SHGKSLEWIG LITPYNGASS YNQKFRGKAT LTVDKSSSTA YMDLLSLTSE DSAVYFCARG GYDGRGFDYW GQGTTVTVSS GGGGSGGGGS GGGGSDIELT QSPAIMSASP GEKVTMTCSA SSSVSYMHWY QQKSGTSPKR WIYDTSKLAS GVPGRFSGSG SGNSYSLTIS SVEAEDDATY YCQQWSKHPL TFGAGTKLEI KAAAGSGGSG FVPVFLPAKP TTTPAPRPPT PAPTIASQPL SLRPEACRPA AGGAVHTRGL DFACDIYIWA PLAGTCGVLL LSLVITLYCN HRNRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 200 | CD2_SS1_spCD8_CD28_CD4 0 | MSFPCKFVAS FLLIFNVSSK GAVSQVQLQQ SGPELEKPGA SVKLSCKASG YSFTGYTMNW VKQSHGKSLE WIGLITPYNG ASSYNQKFRG KATLTVDKSS STAYMDLLSL TSEDSAVYFC ARGGYDGRGF DYWGQGTTVT VSSGGGGSGG GGSGGGGSDI ELTQSPAIMS ASPGEKVTMT CSASSSVSYM HWYQQKSGTS PKRWIYDTSK LASGVPGRFS GSGSGNSYSL TISSVEAEDD ATYYCQQWSK HPLTFGAGTK LEIKAAAGSG SGFVPVFLP AKPTTTPAPR PPTPAPTIAS QPLSLRPEAC RPAAGGAVHT RGLDFACDIY IWAPLAGTCG VLLLSLVITL YCNHRNRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |
| 201 | IL2_SS1_spCD8_CD28_CD4 0 | MYRMQLLSCI ALSLALVTNS QVQLQQSGPE LEKPGASVKL SCKASGYSFT GYTMNWVKQS HGKSLEWIGL ITPYNGASSY NQKFRGKATL TVDKSSSTAY MDLLSLTSED SAVYFCARGG YDGRGFDYWG QGTTVTVSSG GGGSGGGGSG GGGSDIELTQ SPAIMSASPG EKVTMTCSAS SSVSYMHWYQ QKSGTSPKRW IYDTSKLASG VPGRFSGSGS GNSYSLTISS VEAEDDATYY CQQWSKHPLT |

TABLE 7-continued

Amino Acid Sequences

| ID No | Component | Sequence |
|---|---|---|
| | | FGAGTKLEIK AAAGSGGSGF VPVFLPAKPT TTPAPRPPTP APTIASQPLS LRPEACRPAA GGAVHTRGLD FACDIYIWAP LAGTCGVLLL SLVITLYCNH RNRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 202 | GM-CSF_SS1_spCD8_CD28_CD40 | MWLQSLLLLG TVACSISQVQ LQQSGPELEK PGASVKLSCK ASGYSFTGYT MNWVKQSHGK SLEWIGLITP YNGASSYNQK FRGKATLTVD KSSSTAYMDL LSLTSEDSAV YFCARGGYDG RGFDYWGQGT TVTVSSGGGG SGGGGSGGGG SDIELTQSPA IMSASPGEKV TMTCSASSSV SYMHWYQQKS GTSPKRWIYD TSKLASGVPG RFSGSGSGNS YSLTISSVEA EDDATYYCQQ WSKHPLTFGA GTKLEIKAAA GSGGSGFVPV FLPAKPTTTP APRPPTPAPT IASQPLSLRP EACRPAAGGA VHTRGLDFAC DIYIWAPLAG TCGVLLLSLV ITLYCNHRNR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 203 | hIgGk-VIII_SS1_spCD8_CD28_CD40 | MEAPAQLLFL LLLWLPDTTR QVQLQQSGPE LEKPGASVKL SCKASGYSFT GYTMNWVKQS HGKSLEWIGL ITPYNGASSY NQKFRGKATL TVDKSSSTAY MDLLSLTSED SAVYFCARGG YDGRGFDYWG QGTTVTVSSG GGGSGGGGSG GGGSDIELTQ SPAIMSASPG EKVTMTCSAS SSVSYMHWYQ QKSGTSPKRW IYDTSKLASG VPGRFSGSGS GNSYSLTISS VEAEDDATYY CQQWSKHPLT FGAGTKLEIK AAAGSGGSGF VPVFLPAKPT TTPAPRPPTP APTIASQPLS LRPEACRPAA GGAVHTRGLD FACDIYIWAP LAGTCGVLLL SLVITLYCNH RNRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 204 | OSM_SS1_CD28TM_CD4 0 | MGVLLTQRTL LSLVLALLFP SMASMQVQLQ QSGPELEKPG ASVKLSCKAS GYSFTGYTMN WVKQSHGKSL EWIGLITPYN GASSYNQKFR GKATLTVDKS SSTAYMDLLS LTSEDSAVYF CARGGYDGRG FDYWGQGTTV TVSSGGGGSG GGGSGGGGSD IELTQSPAIM SASPGEKVTM TCSASSSVSY MHWYQQKSGT SPKRWIYDTS KLASGVPGRF SGSGSGNSYS LTISSVEAED DATYYCQQWS KHPLTFGAGT KLEIKAAAGS GGSGFWVLVV VGGVLACYSL LVTVAFIIFW VRSKRSRLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |
| 205 | CD8a_SS1_CD28TM_CD4 0 | MALPVTALLL PLALLLHAAR PQVQLQQSGP ELEKPGASVK LSCKASGYSF TGYTMNWVKQ SHGKSLEWIG LITPYNGASS YNQKFRGKAT LTVDKSSSTA YMDLLSLTSE DSAVYFCARG GYDGRGFDYW GQGTTVTVSS GGGGSGGGGS GGGGSDIELT QSPAIMSASP GEKVTMTCSA SSSVSYMHWY QQKSGTSPKR WIYDTSKLAS GVPGRFSGSG SGNSYSLTIS SVEAEDDATY YCQQWSKHPL TFGAGTKLEI KAAAGSGGSG FWVLVVGGV LACYSLLVTV AFIIFWVRSK RSRLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |
| 206 | CD2_SS1_CD28TM_CD28_CD40 | MSFPCKFVAS FLLIFNVSSK GAVSQVQLQQ SGPELEKPGA SVKLSCKASG YSFTGYTMNW VKQSHGKSLE WIGLITPYNG ASSYNQKFRG KATLTVDKSS STAYMDLLSL TSEDSAVYFC ARGGYDGRGF DYWGQGTTVT VSSGGGGSGG GGSGGGGSDI ELTQSPAIMS ASPGEKVTMT CSASSSVSYM HWYQQKSGTS PKRWIYDTSK LASGVPGRFS GSGSGNSYSL TISSVEAEDD ATYYCQQWSK HPLTFGAGTK LEIKAAAGSG GSGFWVLVVV GGVLACYSLL VTVAFIIFWV RSKRSRLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |
| 207 | IL2_SS1_CD28TM_CD4 0 | MYRMQLLSCI ALSLALVTNS QVQLQQSGPE LEKPGASVKL SCKASGYSFT GYTMNWVKQS HGKSLEWIGL ITPYNGASSY NQKFRGKATL TVDKSSSTAY MDLLSLTSED SAVYFCARGG YDGRGFDYWG QGTTVTVSSG GGGSGGGGSG GGGSDIELTQ SPAIMSASPG EKVTMTCSAS SSVSYMHWYQ QKSGTSPKRW IYDTSKLASG VPGRFSGSGS GNSYSLTISS VEAEDDATYY CQQWSKHPLT FGAGTKLEIK AAAGSGGSGF WVLVVGGVL ACYSLLVTVA FIIFWVRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |
| 208 | GM-CSF_SS1_CD28TM_CD4 0 | MWLQSLLLLG TVACSISQVQ LQQSGPELEK PGASVKLSCK ASGYSFTGYT MNWVKQSHGK SLEWIGLITP YNGASSYNQK FRGKATLTVD KSSSTAYMDL LSLTSEDSAV YFCARGGYDG RGFDYWGQGT TVTVSSGGGG SGGGGSGGGG SDIELTQSPA IMSASPGEKV TMTCSASSSV SYMHWYQQKS GTSPKRWIYD TSKLASGVPG RFSGSGSGNS YSLTISSVEA EDDATYYCQQ WSKHPLTFGA GTKLEIKAAA GSGGSGFWVL VVVGGVLACY SLLVTVAFII FWVRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |

TABLE 7-continued

Amino Acid Sequences

| ID No | Component | Sequence |
|---|---|---|
| 209 | hIgGk-VIII_SS1_CD28TM_CD28_CD4 0 | MEAPAQLLFL LLLWLPDTTR QVQLQQSGPE LEKPGASVKL SCKASGYSFT GYTMNWVKQS HGKSLEWIGL ITPYNGASSY NQKFRGKATL TVDKSSSTAY MDLLSLTSED SAVYFCARGG YDGRGFDYWG QGTTVTVSSG GGGSGGGGSG GGGSDIELTQ SPAIMSASPG EKVTMTCSAS SSVSYMHWYQ QKSGTSPKRW IYDTSKLASG VPGRFSGSGS GNSYSLTISS VEAEDDATYY CQQWSKHPLT FGAGTKLEIK AAAGSGGSGF WVLVVVGGVL ACYSLLVTVA FIIFWVRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |
| 210 | OSM_M5_spCD28_CD28_CD4 0 CTP225 | MGVLLTQRTL LSLVLALLFP SMASMQVQLV QSGAEVEKPG ASVKVSCKAS GYTFTDYYMH WVRQAPGQGL EWMGWINPNS GGTNYAQKFQ GRVTMTRDTS ISTAYMELSR LRSDDTAVYY CASGWDFDYW GQGTLVTVSS GGGGSGGGGS GGGGSDIVMT QSPSSLSASV GDRVTITCRA SQSIRYYLSW YQQKPGKAPK LLIYTASILQ NGVPSRFSGS GSGTDFTLTI SSLQPEDFAT YYCLQTYTTP DFGPGTKVEI KAAAGSGGSG ILVKQSPMLV AYDNAVNLSC KYSYNLFSRE FRASLHKGLD SAVEVCVVYG NYSQQLQVYS KTGFNCDGKL GNESVTFYLQ NLYVNQTDIY FCKIEVMYPP PYLDNEKSNG TIIHVKGKHL CPSPLFPGPS KPFWVLVVVG GVLACYSLLV TVAFIIFWVR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 211 | CD8a_M5_spCD28_CD28_CD4 0 | MALPVTALLL PLALLLHAAR PQVQLVQSGA EVEKPGASVK VSCKASGYTF TDYYMHWVRQ APGQGLEWMG WINPNSGGTN YAQKFQGRVT MTRDTSISTA YMELSRLRSD DTAVYYCASG WDFDYWGQGT LVTVSSGGGG SGGGGSGGGG SDIVMTQSPS SLSASVGDRV TITCRASQSI RYYLSWYQQK PGKAPKLLIY TASILQNGVP SRFSGSGSGT DFTLTISSLQ PEDFATYYCL QTYTTPDFGP GTKVEIKAAA GSGGSGILVK QSPMLVAYDN AVNLSCKYSY NLFSREFRAS LHKGLDSAVE VCVVYGNYSQ QLQVYSKTGF NCDGKLGNES VTFYLQNLYV NQTDIYFCKI EVMYPPPYLD NEKSNGTIIH VKGKHLCPSP LFPGPSKPFW VLVVVGGVLA CYSLLVTVAF IIFWVRSKRS RLLHSDYMNM TPRRPGPTRK HYQPYAPPRD FAAYRSKKVA KKPTNKAHP KQEPQEINFP DDLPGSNTAA PVQETLHGCQ PVTQEDGKES RISVQERQ |
| 212 | CD2_M5_spCD28_CD28_CD4 0 | MSFPCKFVAS FLLIFNVSSK GAVSQVQLVQ SGAEVEKPGA SVKVSCKASG YTFTDYYMHW VRQAPGQGLE WMGWINPNSG GTNYAQKFQG RVTMTRDTSI STAYMELSRL RSDDTAVYYC ASGWDFDYWG QGTLVTVSSG GGGSGGGGSG GGGSDIVMTQ SPSSLSASVG DRVTITCRAS QSIRYYLSWY QQKPGKAPKL LIYTASILQN GVPSRFSGSG SGTDFTLTIS SLQPEDFATY YCLQTYTTPD FGPGTKVEIK AAAGSGGSGI LVKQSPMLVA YDNAVNLSCK YSYNLFSREF RASLHKGLDS AVEVCVVYGN YSQQLQVYSK TGFNCDGKLG NESVTFYLQN LYVNQTDIYF CKIEVMYPPP YLDNEKSNGT IIHVKGKHLC PSPLFPGPSK PFWVLVVGG VLACYSLLVT VAFIIFWVRS KRSRLLHSDY MNMTPRRPGP TRKHYQPYAP PRDFAAYRSK VAKKPTNKA PHPKQEPQEI NFPDDLPGSN TAAPVQETLH GCQPVTQEDG KESRISVQER Q |
| 213 | IL2_M5_spCD28_CD28_CD4 0 | MYRMQLLSCI ALSLALVTNS QVQLVQSGAE VEKPGASVKV SCKASGYTFT DYYMHWVRQA PGQGLEWMGW INPNSGGTNY AQKFQGRVTM TRDTSISTAY MELSRLRSDD TAVYYCASGW DFDYWGQGTL VTVSSGGGGS GGGGSGGGGS DIVMTQSPSS LSASVGDRVT ITCRASQSIR YYLSWYQQKP GKAPKLLIYT ASILQNGVPS RFSGSGSGTD FTLTISSLQP EDFATYYCLQ TYTTPDFGPG TKVEIKAAAG SGGSGILVKQ SPMLVAYDNA VNLSCKYSYN LFSREFRASL HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 214 | GM-CSF_M5_spCD28_CD28_CD4 0 | MWLQSLLLLG TVACSISQVQ LVQSGAEVEK PGASVKVSCK ASGYTFTDYY MHWVRQAPGQ GLEWMGWINP NSGGTNYAQK FQGRVTMTRD TSISTAYMEL SRLRSDDTAV YYCASGWDFD YWGQGTLVTV SSGGGGSGGG GSGGGGSDIV MTQSPSSLSA SVGDRVTITC RASQSIRYYL SWYQQKPGKA PKLLIYTASI LQNGVPSRFS GSGSGTDFTL TISSLQPEDF ATYYCLQTYT TPDFGPGTKV EIKAAAGSGG SGILVKQSPM LVAYDNAVNL SCKYSYNLFS REFRASLHKG LDSAVEVCVV YGNYSQQLQV YSKTGFNCDG KLGNESVTFY LQNLYVNQTD IYFCKIEVMY PPPYLDNEKS NGTIIHVKGK HLCPSPLFPG PSKPFWVLVV VGGVLACYSL LVTVAFIIFW VRSKRSLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |
| 215 | hIgGk-VIII_M5_spCD28_CD28_CD4 0 | MEAPAQLLFL LLLWLPDTTR QVQLVQSGAE VEKPGASVKV SCKASGYTFT DYYMHWVRQA PGQGLEWMGW INPNSGGTNY AQKFQGRVTM TRDTSISTAY MELSRLRSDD TAVYYCASGW DFDYWGQGTL VTVSSGGGGS GGGGSGGGGS DIVMTQSPSS LSASVGDRVT ITCRASQSIR YYLSWYQQKP GKAPKLLIYT ASILQNGVPS RFSGSGSGTD FTLTISSLQP EDFATYYCLQ TYTTPDFGPG TKVEIKAAAG SGGSGILVKQ SPMLVAYDNA VNLSCKYSYN LFSREFRASL |

TABLE 7-continued

Amino Acid Sequences

| ID No | Component | Sequence |
|---|---|---|
| | | HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 216 | OSM_M5 _spCD8 _CD28_CD4 0 CTP237 | MGVLLTQRTL LSLVLALLFP SMASMQVQLV QSGAEVEKPG ASVKVSCKAS GYTFTDYYMH WVRQAPGQGL EWMGWINPNS GGTNYAQKFQ GRVTMTRDTS ISTAYMELSR LRSDDTAVYY CASGWDFDYW GQGTLVTVSS GGGGSGGGGS GGGGSDIVMT QSPSSLSASV GDRVTITCRA SQSIRYYLSW YQQKPGKAPK LLIYTASILQ NGVPSRFSGS GSGTDFTLTI SSLQPEDFAT YYCLQTYTTP DFGPGTKVEI KAAAGSGGSG FVPVFLPAKP TTTPAPRPPT PAPTIASQPL SLRPEACRPA AGGAVHTRGL DFACDIYIWA PLAGTCGVLL LSLVITLYCN HRNRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 217 | CD8a_M5 _spCD8 _CD28_CD4 0 | MALPVTALLL PLALLLHAAR PQVQLVQSGA EVEKPGASVK VSCKASGYTF TDYYMHWVRQ APGQGLEWMG WINPNSGGTN YAQKFQGRVT MTRDTSISTA YMELSRLRSD DTAVYYCASG WDFDYWGQGT LVTVSSGGGG SGGGGSGGGG SDIVMTQSPS SLSASVGDRV TITCRASQSI RYYLSWYQQK PGKAPKLLIY TASILQNGVP SRFSGSGSGT DFTLTISSLQ PEDFATYYCL QTYTTPDFGP GTKVEIKAAA GSGGSGFVPV FLPAKPTTTP APRPPTPAPT IASQPLSLRP EACRPAAGGA VHTRGLDFAC DIYIWAPLAG TCGVLLLSLV ITLYCNHRNR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 218 | CD2_M5 _spCD8 _CD28_CD4 0 | MSFPCKFVAS FLLIFNVSSK GAVSQVQLVQ SGAEVEKPGA SVKVSCKASG YTFTDYYMHW VRQAPGQGLE WMGWINPNSG GTNYAQKFQG RVTMTRDTSI STAYMELSRL RSDDTAVYYC ASGWDFDYWG QGTLVTVSSG GGGSGGGGSG GGGSDIVMTQ SPSSLSASVG DRVTITCRAS QSIRYYLSWY QQKPGKAPKL LIYTASILQN GVPSRFSGSG SGTDFTLTIS SLQPEDFATY YCLQTYTTPD FGPGTKVEIK AAAGSGGSGF VPVFLPAKPT TTPAPRPPTP APTIASQPLS LRPEACRPAA GGAVHTRGLD FACDIYIWAP LAGTCGVLLL SLVITLYCNH RNRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 219 | IL2_M5 _spCD8 _CD28_CD4 0 | MYRMQLLSCI ALSLALVTNS QVQLVQSGAE VEKPGASVKV SCKASGYTFT DYYMHWVRQA PGQGLEWMGW INPNSGGTNY AQKFQGRVTM TRDTSISTAY MELSRLRSDD TAVYYCASGW DFDYWGQGTL VTVSSGGGGS GGGGSGGGGS DIVMTQSPSS LSASVGDRVT ITCRASQSIR YYLSWYQQKP GKAPKLLIYT ASILQNGVPS RFSGSGSGTD FTLTISSLQP EDFATYYCLQ TYTTPDFGPG TKVEIKAAAG SGGSGFVPVF LPAKPTTTPA PRPPTPAPTI ASQPLSLRPE ACRPAAGGAV HTRGLDFACD IYIWAPLAGT CGVLLLSLVI TLYCNHRNRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 220 | GM- CSF_M5 _spCD8 _CD28_CD4 0 | MWLQSLLLLG TVACSISQVQ LVQSGAEVEK PGASVKVSCK ASGYTFTDYY MHWVRQAPGQ GLEWMGWINP NSGGTNYAQK FQGRVTMTRD TSISTAYMEL SRLRSDDTAV YYCASGWDFD YWGQGTLVTV SSGGGGSGGG GSGGGGSDIV MTQSPSSLSA SVGDRVTITC RASQSIRYYL SWYQQKPGKA PKLLIYTASI LQNGVPSRFS GSGSGTDFTL TISSLQPEDF ATYYCLQTYT TPDFGPGTKV EIKAAAGSGG SGFVPVFLPA KPTTTPAPRP PTPAPTIASQ PLSLRPEACR PAAGGAVHTR GLDFACDIYI WAPLAGTCGV LLLSLVITLY CNHRNRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 221 | hIgGk- VIII _M5_spCD8 _CD28_CD4 0 | MEAPAQLLFL LLLWLPDTTR QVQLVQSGAE VEKPGASVKV SCKASGYTFT DYYMHWVRQA PGQGLEWMGW INPNSGGTNY AQKFQGRVTM TRDTSISTAY MELSRLRSDD TAVYYCASGW DFDYWGQGTL VTVSSGGGGS GGGGSGGGGS DIVMTQSPSS LSASVGDRVT ITCRASQSIR YYLSWYQQKP GKAPKLLIYT ASILQNGVPS RFSGSGSGTD FTLTISSLQP EDFATYYCLQ TYTTPDFGPG TKVEIKAAAG SGGSGFVPVF LPAKPTTTPA PRPPTPAPTI ASQPLSLRPE ACRPAAGGAV HTRGLDFACD IYIWAPLAGT CGVLLLSLVI TLYCNHRNRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 222 | OSM_M5 _CD28TM _CD28_CD4 0 | MGVLLTQRTL LSLVLALLFP SMASMQVQLV QSGAEVEKPG ASVKVSCKAS GYTFTDYYMH WVRQAPGQGL EWMGWINPNS GGTNYAQKFQ GRVTMTRDTS ISTAYMELSR LRSDDTAVYY CASGWDFDYW GQGTLVTVSS GGGGSGGGGS GGGGSDIVMT QSPSSLSASV GDRVTITCRA SQSIRYYLSW YQQKPGKAPK |

TABLE 7-continued

Amino Acid Sequences

| ID No | Component | Sequence |
|---|---|---|
| | | LLIYTASILQ NGVPSRFSGS GSGTDFTLTI SSLQPEDFAT YYCLQTYTTP |
| | | DFGPGTKVEI KAAAGSGGGS FWVLVVVGGV LACYSLLVTV AFIIFWVRSK |
| | | RSRLLHSDYM NMTPRRPGPT RKHYQPYAPP RDFAAYRSKK VAKKPTNKAP |
| | | HPKQEPQEIN FPDDLPGSNT AAPVQETLHG CQPVTQEDGK ESRISVQERQ |
| 223 | CD8a_M5_CD28TM_CD28_CD40 | MALPVTALLL PLALLLHAAR PQVQLVQSGA EVEKPGASVK VSCKASGYTF TDYYMHWVRQ APGQGLEWMG WINPNSGGTN YAQKFQGRVT MTRDTSISTA YMELSRLRSD DTAVYYCASG WDFDYWGQGT LVTVSSGGGG SGGGGSGGGG SDIVMTQSPS SLSASVGDRV TITCRASQSI RYYLSWYQQK PGKAPKLLIY TASILQNGVP SRFSGSGSGT DFTLTISSLQ PEDFATYYCL QTYTTPDFGP GTKVEIKAAA GSGGGSGFWVL VVVGGVLACY SLLVTVAFII FWVRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 224 | CD2_M5_CD28TM_CD28_CD40 | MSFPCKFVAS FLLIFNVSSK GAVSQVQLVQ SGAEVEKPGA SVKVSCKASG YTFTDYYMHW VRQAPGQGLE WMGWINPNSG GTNYAQKFQG RVTMTRDTSI STAYMELSRL RSDDTAVYYC ASGWDFDYWG QGTLVTVSSG GGGSGGGGSG GGGSDIVMTQ SPSSLSASVG DRVTITCRAS QSIRYYLSWY QQKPGKAPKL LIYTASILQN GVPSRFSGSG SGTDFTLTIS SLQPEDFATY YCLQTYTTPD FGPGTKVEIK AAAGSGGGSGF WVLVVVGGVL ACYSLLVTVA FIIFWVRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |
| 225 | IL2_M5_CD28TM_CD28_CD40 | MYRMQLLSCI ALSLALVTNS QVQLVQSGAE VEKPGASVKV SCKASGYTFT DYYMHWVRQA PGQGLEWMGW INPNSGGTNY AQKFQGRVTM TRDTSISTAY MELSRLRSDD TAVYYCASGW DFDYWGQGTL VTVSSGGGGS GGGGSGGGGS DIVMTQSPSS LSASVGDRVT ITCRASQSIR YYLSWYQQKP GKAPKLLIYT ASILQNGVPS RFSGSGSGTD FTLTISSLQP EDFATYYCLQ TYTTPDFGPG TKVEIKAAAG SGGGSGFWVLV VVGGVLACYS LLVTVAFIIF WVRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 226 | GM-CSF_M5_CD28TM_CD28_CD40 | MWLQSLLLLG TVACSISQVQ LVQSGAEVEK PGASVKVSCK ASGYTFTDYY MHWVRQAPGQ GLEWMGWINP NSGGTNYAQK FQGRVTMTRD TSISTAYMEL SRLRSDDTAV YYCASGWDFD YWGQGTLVTV SSGGGGSGGG GSGGGGSDIV MTQSPSSLSA SVGDRVTITC RASQSIRYYL SWYQQKPGKA PKLLIYTASI LQNGVPSRFS GSGSGTDFTL TISSLQPEDF ATYYCLQTYT TPDFGPGTKV EIKAAAGSGG SGFWVLVVVG GVLACYSLLV TVAFIIFWVR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 227 | hIgGk-VIII_M5_CD28TM_CD28_CD40 | MEAPAQLLFL LLLWLPDTTR QVQLVQSGAE VEKPGASVKV SCKASGYTFT DYYMHWVRQA PGQGLEWMGW INPNSGGTNY AQKFQGRVTM TRDTSISTAY MELSRLRSDD TAVYYCASGW DFDYWGQGTL VTVSSGGGGS GGGGSGGGGS DIVMTQSPSS LSASVGDRVT ITCRASQSIR YYLSWYQQKP GKAPKLLIYT ASILQNGVPS RFSGSGSGTD FTLTISSLQP EDFATYYCLQ TYTTPDFGPG TKVEIKAAAG SGGGSGFWVLV VVGGVLACYS LLVTVAFIIF WVRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 228 | OSM_HN1_spCD28_CD28_CD40_CTP226 | MGVLLTQRTL LSLVLALLFP SMASMQVQLV QSGAEVKRPG ASVQVSCRAS GYSINTYYMQ WVRQAPGAGL EWMGVINPSG VTSYAQKFQG RVTLTNDTST NTVYMQLNSL TSADTAVYYC ARWALWGDFG MDVWGKGTLV TVSSGGGGSG GGGSGGGGSD IQMTQSPSTL SASIGDRVTI TCRASEGIYH WLAWYQQKPG KAPKLLIYKA SSLASGAPSR FSGSGSGTDF TLTISSLQPD DFATYYCQQY SNYPLTFGGG TKLEIKAAAG SGGSGILVKQ SPMLVAYDNA VNLSCKYSYN LFSREFRASL HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 229 | CD8a_HN1_spCD28_CD28_CD40 | MALPVTALLL PLALLLHAAR PQVQLVQSGA EVKRPGASVQ VSCRASGYSI NTYYMQWVRQ APGAGLEWMG VINPSGVTSY AQKFQGRVTL TNDTSTNTVY MQLNSLTSAD TAVYYCARWA LWGDFGMDVW GKGTLVTVSS GGGGSGGGGS GGGGSDIQMT QSPSTLSASI GDRVTITCRA SEGIYHWLAW YQQKPGKAPK LLIYKASSLA SGAPSRFSGS GSGTDFTLTI SSLQPDDFAT YYCQQYSNYP LTFGGGTKLE IKAAAGSGGS GILVKQSPML VAYDNAVNLS CKYSYNLFSR EFRASLHKGL DSAVEVCVVY GNYSQQLQVY SKTGFNCDGK LGNESVTFYL QNLYVNQTDI YFCKIEVMYP PPYLDNEKSN GTIIHVKGKH LCPSPLFPGP SKPFWVLVVV GGVLACYSLL VTAFIIFWV RSKRSRLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |

TABLE 7-continued

Amino Acid Sequences

| ID No | Component | Sequence |
|---|---|---|
| 230 | CD2_HN1_spCD28_CD28_CD4 0 | MSFPCKFVAS FLLIFNVSSK GAVSQVQLVQ SGAEVKRPGA SVQVSCRASG YSINTYYMQW VRQAPGAGLE WMGVINPSGV TSYAQKFQGR VTLTNDTSTN TVYMQLNSLT SADTAVYYCA RWALWGDFGM DVWGKGTLVT VSSGGGGSGG GGSGGGGSDI QMTQSPSTLS ASIGDRVTIT CRASEGIYHW LAWYQQKPGK APKLLIYKAS SLASGAPSRF SGSGSGTDFT LTISSLQPDD FATYYCQQYS NYPLTFGGGT KLEIKAAAGS GGSGILVKQS PMLVAYDNAV NLSCKYSYNL FSREFRASLH KGLDSAVEVC VVYGNYSQQL QVYSKTGFNC DGKLGNESVT FYLQNLYVNQ TDIYFCKIEV MYPPPYLDNE KSNGTIIHVK GKHLCPSPLF PGPSKPFWVL VVVGGVLACY SLLVTVAFII FWVRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 231 | IL2_HN1_spCD28_CD28_CD4 0 | MYRMQLLSCI ALSLALVTNS QVQLVQSGAE VKRPGASVQV SCRASGYSIN TYYMQWVRQA PGAGLEWMGV INPSGVTSYA QKFQGRVTLT NDTSTNTVYM QLNSLTSADT AVYYCARWAL WGDFGMDVWG KGTLVTVSSG GGGSGGGGSG GGGSDIQMTQ SPSTLSASIG DRVTITCRAS EGIYHWLAWY QQKPGKAPKL LIYKASSLAS GAPSRFSGSG SGTDFTLTIS SLQPDDFATY YCQQYSNYPL TFGGGTKLEI KAAAGSGGSG ILVKQSPMLV AYDNAVNLSC KYSYNLFSRE FRASLHKGLD SAVEVCVVYG NYSQQLQVYS KTGFNCDGKL GNESVTFYLQ NLYVNQTDIY FCKIEVMYPP PYLDNEKSNG TIIHVKGKHL CPSPLFPGPS KPFWVLVVVG GVLACYSLLV TVAFIIFWVR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 232 | GM-CSF_HN1_spCD28_CD28_CD4 0 | MWLQSLLLLG TVACSISQVQ LVQSGAEVKR PGASVQVSCR ASGYSINTYY MQWVRQAPGA GLEWMGVINP SGVTSYAQKF QGRVTLTNDT STNTVYMQLN SLTSADTAVY YCARWALWGD FGMDVWGKGT LVTVSSGGGG SGGGGSGGGG SDIQMTQSPS TLSASIGDRV TITCRASEGI YHWLAWYQQK PGKAPKLLIY KASSLASGAP SRFSGSGSGT DFTLTISSLQ PDDFATYYCQ QYSNYPLTFG GGTKLEIKAA AGSGGSGILV KQSPMLVAYD NAVNLSCKYS YNLFSREFRA SLHKGLDSAV EVCVVYGNYS QQLQVYSKTG FNCDGKLGNE SVTFYLQNLY VNQTDIYFCK IEVMYPPPYL DNEKSNGTII HVKGKHLCPS PLFPGPSKPF WVLVVVGGVL ACYSLLVTVA FIIFWVRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |
| 233 | hIgGk-VIII_HN1_spCD28_CD28_CD4 0 | MEAPAQLLFL LLLWLPDTTR QVQLVQSGAE VKRPGASVQV SCRASGYSIN TYYMQWVRQA PGAGLEWMGV INPSGVTSYA QKFQGRVTLT NDTSTNTVYM QLNSLTSADT AVYYCARWAL WGDFGMDVWG KGTLVTVSSG GGGSGGGGSG GGGSDIQMTQ SPSTLSASIG DRVTITCRAS EGIYHWLAWY QQKPGKAPKL LIYKASSLAS GAPSRFSGSG SGTDFTLTIS SLQPDDFATY YCQQYSNYPL TFGGGTKLEI KAAAGSGGSG ILVKQSPMLV AYDNAVNLSC KYSYNLFSRE FRASLHKGLD SAVEVCVVYG NYSQQLQVYS KTGFNCDGKL GNESVTFYLQ NLYVNQTDIY FCKIEVMYPP PYLDNEKSNG TIIHVKGKHL CPSPLFPGPS KPFWVLVVVG GVLACYSLLV TVAFIIFWVR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 234 | OSM_HN1_spCD8_CD28_CD4 0 CTP238 | MGVLLTQRTL LSLVLALLFP SMASMQVQLV QSGAEVKRPG ASVQVSCRAS GYSINTYYMQ WVRQAPGAGL EWMGVINPSG VTSYAQKFQG RVTLTNDTST NTVYMQLNSL TSADTAVYYC ARWALWGDFG MDVWGKGTLV TVSSGGGGSG GGGSGGGGSD IQMTQSPSTL SASIGDRVTI TCRASEGIYH WLAWYQQKPG KAPKLLIYKA SSLASGAPSR FSGSGSGTDF TLTISSLQPD DFATYYCQQY SNYPLTFGGG TKLEIKAAAG SGGSGFVPVF LPAKPTTTPA PRPPTPAPTI ASQPLSLRPE ACRPAAGGAV HTRGLDFACD IYIWAPLAGT CGVLLLSLVI TLYCNHRNRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 235 | CD8a_HN1_spCD8_CD28_CD4 0 | MALPVTALLL PLALLLHAAR PQVQLVQSGA EVKRPGASVQ VSCRASGYSI NTYYMQWVRQ APGAGLEWMG VINPSGVTSY AQKFQGRVTL TNDTSTNTVY MQLNSLTSAD TAVYYCARWA LWGDFGMDVW GKGTLVTVSS GGGGSGGGGS GGGGSDIQMT QSPSTLSASI GDRVTITCRA SEGIYHWLAW YQQKPGKAPK LLIYKASSLA SGAPSRFSGS GSGTDFTLTI SSLQPDDFAT YYCQQYSNYP LTFGGGTKLE IKAAAGSGGS GFVPVFLPAK PTTTPAPRPP TPAPTIASQP LSLRPEACRP AAGGAVHTRG LDFACDIYIW APLAGTCGVL LLSLVITLYC NHRNRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 236 | CD2_HN1_spCD8_CD28_CD4 0 | MSFPCKFVAS FLLIFNVSSK GAVSQVQLVQ SGAEVKRPGA SVQVSCRASG YSINTYYMQW VRQAPGAGLE WMGVINPSGV TSYAQKFQGR VTLTNDTSTN TVYMQLNSLT SADTAVYYCA RWALWGDFGM DVWGKGTLVT VSSGGGGSGG GGSGGGGSDI QMTQSPSTLS ASIGDRVTIT CRASEGIYHW LAWYQQKPGK |

TABLE 7-continued

Amino Acid Sequences

| ID No | Component | Sequence |
|---|---|---|
| | | APKLLIYKAS SLASGAPSRF SGSGSGTDFT LTISSLQPDD FATYYCQQYS NYPLTFGGGT KLEIKAAAGS GGSGFVPVFL PAKPTTTPAP RPPTPAPTIA SQPLSLRPEA CRPAAGGAVH TRGLDFACDI YIWAPLAGTC GVLLLSLVIT LYCNHRNRSK RSRLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |
| 237 | IL2_HN1 _spCD8 _CD28_CD4 0 | MYRMQLLSCI ALSLALVTNS QVQLVQSGAE VKRPGASVQV SCRASGYSIN TYYMQWVRQA PGAGLEWMGV INPSGVTSYA QKFQGRVTLT NDTSTNTVYM QLNSLTSADT AVYYCARWAL WGDFGMDVWG KGTLVTVSSG GGSGGGGSG GGGSDIQMTQ SPSTLSASIG DRVTITCRAS EGIYHWLAWY QQKPGKAPKL LIYKASSLAS GAPSRFSGSG SGTDFTLTIS SLQPDDFATY YCQQYSNYPL TFGGGTKLEI KAAAGSGGS FVPVFLPAKP TTTPAPRPPT PAPTIASQPL SLRPEACRPA AGGAVHTRGL DFACDIYIWA PLAGTCGVLL LSLVITLYCN HRNRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 238 | GM-CSF_HN1 _spCD8 _CD28_CD4 0 | MWLQSLLLLG TVACSISQVQ LVQSGAEVKR PGASVQVSCR ASGYSINTYY MQWVRQAPGA GLEWMGVINP SGVTSYAQKF QGRVTLTNDT STNTVYMQLN SLTSADTAVY YCARWALWGD FGMDVWGKGT LVTVSSGGGG SGGGGSGGGG SDIQMTQSPS TLSASIGDRV TITCRASEGI YHWLAWYQQK PGKAPKLLIY KASSLASGAP SRFSGSGSGT DFTLTISSLQ PDDFATYYCQ QYSNYPLTFG GGTKLEIKAA AGSGGSGFVP VFLPAKPTTT PAPRPPTPAP TIASQPLSLR PEACRPAAGG AVHTRGLDFA CDIYIWAPLA GTCGVLLLSL VITLYCNHRN RSKRSRLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |
| 239 | hIgGk-VIII _HN1 _spCD8 _CD28_CD4 0 | MEAPAQLLFL LLLWLPDTTR QVQLVQSGAE VKRPGASVQV SCRASGYSIN TYYMQWVRQA PGAGLEWMGV INPSGVTSYA QKFQGRVTLT NDTSTNTVYM QLNSLTSADT AVYYCARWAL WGDFGMDVWG KGTLVTVSSG GGSGGGGSG GGGSDIQMTQ SPSTLSASIG DRVTITCRAS EGIYHWLAWY QQKPGKAPKL LIYKASSLAS GAPSRFSGSG SGTDFTLTIS SLQPDDFATY YCQQYSNYPL TFGGGTKLEI KAAAGSGGS FVPVFLPAKP TTTPAPRPPT PAPTIASQPL SLRPEACRPA AGGAVHTRGL DFACDIYIWA PLAGTCGVLL LSLVITLYCN HRNRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 240 | OSM_HN1 _CD28TM _CD28_CD4 0 | MGVLLTQRTL LSLVLALLFP SMASMQVQLV QSGAEVKRPG ASVQVSCRAS GYSINTYYMQ WVRQAPGAGL EWMGVINPSG VTSYAQKFQG RVTLTNDTST NTVYMQLNSL TSADTAVYYC ARWALWGDFG MDVWGKGTLV TVSSGGGGSG GGGSGGGGSD IQMTQSPSTL SASIGDRVTI TCRASEGIYH WLAWYQQKPG KAPKLLIYKA SSLASGAPSR FSGSGSGTDF TLTISSLQPD DFATYYCQQY SNYPLTFGGG TKLEIKAAAG SGGGFWVLV VVGGVLACYS LLVTVAFIIF WVRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 241 | CD8a_HN1 _CD28TM _CD28_CD4 0 | MALPVTALLL PLALLLHAAR PQVQLVQSGA EVKRPGASVQ VSCRASGYSI NTYYMQWVRQ APGAGLEWMG VINPSGVTSY AQKFQGRVTL TNDTSTNTVY MQLNSLTSAD TAVYYCARWA LWGDFGMDVW GKGTLVTVSS GGGGSGGGGS GGGGSDIQMT QSPSTLSASI GDRVTITCRA SEGIYHWLAW YQQKPGKAPK LLIYKASSLA SGAPSRFSGS GSGTDFTLTI SSLQPDDFAT YYCQQYSNYP LTFGGGTKLE IKAAAGSGGG FWVLVVVGG VLACYSLLVT VAFIIFWVRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 242 | CD2_HN1 _CD28TM _CD28_CD4 0 | MSFPCKFVAS FLLIFNVSSK GAVSQVQLVQ SGAEVKRPGA SVQVSCRASG YSINTYYMQW VRQAPGAGLE WMGVINPSGV TSYAQKFQGR VTLTNDTSTN TVYMQLNSLT SADTAVYYCA RWALWGDFGM DVWGKGTLVT VSSGGGGSGG GGSGGGGSDI QMTQSPSTLS ASIGDRVTIT CRASEGIYHW LAWYQQKPGK APKLLIYKAS SLASGAPSRF SGSGSGTDFT LTISSLQPDD FATYYCQQYS NYPLTFGGGT KLEIKAAAGS GGSGFWVLVV VGGVLACYSL LVTVAFIIFW VRSKRSRLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |

TABLE 7-continued

Amino Acid Sequences

| ID No | Component | Sequence |
|---|---|---|
| 243 | IL2_HN1_CD28TM_CD28_CD40 | MYRMQLLSCI ALSLALVTNS QVQLVQSGAE VKRPGASVQV SCRASGYSIN TYYMQWVRQA PGAGLEWMGV INPSGVTSYA QKFQGRVTLT NDTSTNTVYM QLNSLTSADT AVYYCARWAL WGDFGMDVWG KGTLVTVSSG GGGSGGGGSG GGGSDIQMTQ SPSTLSASIG DRVTITCRAS EGIYHWLAWY QQKPGKAPKL LIYKASSLAS GAPSRFSGSG SGTDFTLTIS SLQPDDFATY YCQQYSNYPL TFGGGTKLEI KAAAGSGGSG FWVLVVVGGV LACYSLLVTV AFIIFWVRSK RSRLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |
| 244 | GM-CSF_HN1_CD28TM_CD28_CD40 | MWLQSLLLLG TVACSISQVQ LVQSGAEVKR PGASVQVSCR ASGYSINTYY MQWVRQAPGA GLEWMGVINP SGVTSYAQKF QGRVTLTNDT STNTVYMQLN SLTSADTAVY YCARWALWGD FGMDVWGKGT LVTVSSGGGG SGGGGSGGGG SDIQMTQSPS TLSASIGDRV TITCRASEGI YHWLAWYQQK PGKAPKLLIY KASSLASGAP SRFSGSGSGT DFTLTISSLQ PDDFATYYCQ QYSNYPLTFG GGTKLEIKAA AGSGGSGFWV LVVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 245 | hIgGk-VIII_HN1_CD28TM_CD28_CD40 | MEAPAQLLFL LLLWLPDTTR QVQLVQSGAE VKRPGASVQV SCRASGYSIN TYYMQWVRQA PGAGLEWMGV INPSGVTSYA QKFQGRVTLT NDTSTNTVYM QLNSLTSADT AVYYCARWAL WGDFGMDVWG KGTLVTVSSG GGGSGGGGSG GGGSDIQMTQ SPSTLSASIG DRVTITCRAS EGIYHWLAWY QQKPGKAPKL LIYKASSLAS GAPSRFSGSG SGTDFTLTIS SLQPDDFATY YCQQYSNYPL TFGGGTKLEI KAAAGSGGSG FWVLVVVGGV LACYSLLVTV AFIIFWVRSK RSRLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |
| 246 | OSM_M912_spCD28_CD28_CD40 CTP227 | MGVLLTQRTL LSLVLALLFP SMASMQVQLQ ESGPGLVKPS ETLSLTCTVS GGSVSSGSYY WSWIRQPPGK GLEWIGYIYY SGSTNYNPSL KSRVTISVDT SKNQFSLKLS SVTAADTAVY YCAREGKNGA FDIWGQGTMV TVSSGGGGSG GGGSGGGGSD IQMTQSPSSL SASVGDRVTI TCRASQSISS YLNWYQQKPG KAPKLLIYAA SSLQSGVPSG FSGSGSGTDF TLTISSLQPE DFATYYCQQS YSTPLTFGGG TKVEIKAAAG SGGSGILVKQ SPMLVAYDNA VNLSCKYSYN LFSREFRASL HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 247 | CD8a_M912_spCD28_CD28_CD40 | MALPVTALLL PLALLLHAAR PQVQLQESGP GLVKPSETLS LTCTVSGGSV SSGSYYWSWI RQPPGKGLEW IGYIYYSGST NYNPSLKSRV TISVDTSKNQ FSLKLSSVTA ADTAVYYCAR EGKNGAFDIW GQGTMVTVSS GGGGSGGGGS GGGGSDIQMT QSPSSLSASV GDRVTITCRA SQSISSYLNW YQQKPGKAPK LLIYAASSLQ SGVPSGFSGS GSGTDFTLTI SSLQPEDFAT YYCQQSYSTP LTFGGGTKVE IKAAAGSGGS GILVKQSPML VAYDNAVNLS CKYSYNLFSR EFRASLHKGL DSAVEVCVVY GNYSQQLQVY SKTGFNCDGK LGNESVTFYL QNLYVNQTDI YFCKIEVMYP PPYLDNEKSN GTIIHVKGKH LCPSPLFPGP SKPFWVLVVV GGVLACYSLL VTVAFIIFWV RSKRSLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |
| 248 | CD2_M912_spCD28_CD28_CD40 | MSFPCKFVAS FLLIFNVSSK GAVSQVQLQE SGPGLVKPSE TLSLTCTVSG GSVSSGSYYW SWIRQPPGKG LEWIGYIYYS GSTNYNPSLK SRVTISVDTS KNQFSLKLSS VTAADTAVYY CAREGKNGAF DIWGQGTMVT VSSGGGGSGG GGSGGGGSDI QMTQSPSSLS ASVGDRVTIT CRASQSISSY LNWYQQKPGK APKLLIYAAS SLQSGVPSGF SGSGSGTDFT LTISSLQPED FATYYCQQSY STPLTFGGGT KVEIKAAAGS GGSGILVKQS PMLVAYDNAV NLSCKYSYNL FSREFRASLH KGLDSAVEVC VVYGNYSQQL QVYSKTGFNC DGKLGNESVT FYLQNLYVNQ TDIYFCKIEV MYPPPYLDNE KSNGTIIHVK GKHLCPSPLF PGPSKPFWVL VVVGGVLACY SLLVTVAFII FWVRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 249 | IL2_M912_spCD28_CD28_CD40 | MYRMQLLSCI ALSLALVTNS QVQLQESGPG LVKPSETLSL TCTVSGGSVS SGSYYWSWIR QPPGKGLEWI GYIYYSGSTN YNPSLKSRVT ISVDTSKNQF SLKLSSVTAA DTAVYYCARE GKNGAFDIWG QGTMVTVSSG GGGSGGGGSG GGSDIQMTQ SPSSLSASVG DRVTITCRAS QSISSYLNWY QQKPGKAPKL LIYAASSLQS GVPSGFSGSG SGTDFTLTIS SLQPEDFATY YCQQSYSTPL TFGGGTKVEI KAAAGSGGSG ILVKQSPMLV AYDNAVNLSC KYSYNLFSRE FRASLHKGLD SAVEVCVVYG NYSQQLQVYS KTGFNCDGKL GNESVTFYLQ NLYVNQTDIY FCKIEVMYPP PYLDNEKSNG TIIHVKGKHL CPSPLFPGPS KPFWVLVVVG GVLACYSLLV TVAFIIFWVR SKRSLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |

TABLE 7-continued

Amino Acid Sequences

| ID No | Component | Sequence |
|---|---|---|
| 250 | GM-CSF_M912_spCD28_CD28_CD40 | MWLQSLLLLG TVACSISQVQ LQESGPGLVK PSETLSLTCT VSGGSVSSGS YYWSWIRQPP GKGLEWIGYI YYSGSTNYNP SLKSRVTISV DTSKNQFSLK LSSVTAADTA VYYCAREGKN GAFDIWGQGT MVTVSSGGGG SGGGGSGGGG SDIQMTQSPS SLSASVGDRV TITCRASQSI SSYLNWYQQK PGKAPKLLIY AASSLQSGVP SGFSGSGSGT DFTLTISSLQ PEDFATYYCQ QSYSTPLTFG GGTKVEIKAA AGSGGSGILV KQSPMLVAYD NAVNLSCKYS YNLFSREFRA SLHKGLDSAV EVCVVYGNYS QQLQVYSKTG FNCDGKLGNE SVTFYLQNLY VNQTDIYFCK IEVMYPPPYL DNEKSNGTII HVKGKHLCPS PLFPGPSKPF WVLVVVGGVL ACYSLLVTVA FIIFWVRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |
| 251 | hIgGk-VIII_M912_spCD28_CD28_CD40 | MEAPAQLLFL LLLWLPDTTR QVQLQESGPG LVKPSETLSL TCTVSGGSVS SGSYYWSWIR QPPGKGLEWI GYIYYSGSTN YNPSLKSRVT ISVDTSKNQF SLKLSSVTAA DTAVYYCARE GKNGAFDIWG QGTMVTVSSG GGGSGGGGSG GGGSDIQMTQ SPSSLSASVG DRVTITCRAS QSISSYLNWY QQKPGKAPKL LIYAASSLQS GVPSGFSGSG SGTDFTLTIS SLQPEDFATY YCQQSYSTPL TFGGGTKVEI KAAAGSGGSG ILVKQSPMLV AYDNAVNLSC KYSYNLFSRE FRASLHKGLD SAVEVCVVYG NYSQQLQVYS KTGFNCDGKL GNESVTFYLQ NLYVNQTDIY FCKIEVMYPP PYLDNEKSNG TIIHVKGKHL CPSPLFPGPS KPFWVLVVVG GVLACYSLLV TVAFIIFWVR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 252 | OSM_M912_spCD8_CD28_CD40_CTP239 | MGVLLTQRTL LSLVLALLFP SMASMQVQLQ ESGPGLVKPS ETLSLTCTVS GGSVSSGSYY WSWIRQPPGK GLEWIGYIYY SGSTNYNPSL KSRVTISVDT SKNQFSLKLS SVTAADTAVY YCAREGKNGA FDIWGQGTMV TVSSGGGGSG GGGSGGGGSD IQMTQSPSSL SASVGDRVTI TCRASQSISS YLNWYQQKPG KAPKLLIYAA SSLQSGVPSG FSGSGSGTDF TLTISSLQPE DFATYYCQQS YSTPLTFGGG TKVEIKAAAG SGGSGFVPVF LPAKPTTTPA PRPPTPAPTI ASQPLSLRPE AGRPAAGGAV HTRGLDFACD IYIWAPLAGT CGVLLLSLVI TLYCNHRNRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 253 | CD8a_M912_spCD8_CD28_CD40 | MALPVTALLL PLALLLHAAR PQVQLQESGP GLVKPSETLS LTCTVSGGSV SSGSYYWSWI RQPPGKGLEW IGYIYYSGST NYNPSLKSRV TISVDTSKNQ FSLKLSSVTA ADTAVYYCAR EGKNGAFDIW GQGTMVTVSS GGGGSGGGGS GGGGSDIQMT QSPSSLSASV GDRVTITCRA SQSISSYLNW YQQKPGKAPK LLIYAASSLQ SGVPSGFSGS GSGTDFTLTI SSLQPEDFAT YYCQQSYSTP LTFGGGTKVE IKAAAGSGGS GFVPVFLPAK PTTTPAPRPP TPAPTIASQP LSLRPEACRP AAGGAVHTRG LDFACDIYIW APLAGTCGVL LLSLVITLYC NHRNRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 254 | CD2_M912_spCD8_CD28_CD40 | MSFPCKFVAS FLLIFNVSSK GAVSQVQLQE SGPGLVKPSE TLSLTCTVSG GSVSSGSYYW SWIRQPPGKG LEWIGYIYYS GSTNYNPSLK SRVTISVDTS KNQFSLKLSS VTAADTAVYY CAREGKNGAF DIWGQGTMVT VSSGGGGSGG GGSGGGGSDI QMTQSPSSLS ASVGDRVTIT CRASQSISSY LNWYQQKPGK APKLLIYAAS SLQSGVPSGF SGSGSGTDFT LTISSLQPED FATYYCQQSY STPLTFGGGT KVEIKAAAGS GGSGFVPVFL PAKPTTTPAP RPPTPAPTIA SQPLSLRPEA CRPAAGGAVH TRGLDFACDI YIWAPLAGTC GVLLLSLVIT LYCNHRNRSK RSRLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |
| 255 | IL2_M912_spCD8_CD28_CD40 | MYRMQLLSCI ALSLALVTNS QVQLQESGPG LVKPSETLSL TCTVSGGSVS SGSYYWSWIR QPPGKGLEWI GYIYYSGSTN YNPSLKSRVT ISVDTSKNQF SLKLSSVTAA DTAVYYCARE GKNGAFDIWG QGTMVTVSSG GGGSGGGGSG GGGSDIQMTQ SPSSLSASVG DRVTITCRAS QSISSYLNWY QQKPGKAPKL LIYAASSLQS GVPSGFSGSG SGTDFTLTIS SLQPEDFATY YCQQSYSTPL TFGGGTKVEI KAAAGSGGSG FVPVFLPAKP TTTPAPRPPT PAPTIASQPL SLRPEACRPA AGGAVHTRGL DFACDIYIWA PLAGTCGVLL LSLVITLYCN HRNRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 256 | GM-CSF_M912_spCD8_CD28_CD40 | MWLQSLLLLG TVACSISQVQ LQESGPGLVK PSETLSLTCT VSGGSVSSGS YYWSWIRQPP GKGLEWIGYI YYSGSTNYNP SLKSRVTISV DTSKNQFSLK LSSVTAADTA VYYCAREGKN GAFDIWGQGT MVTVSSGGGG SGGGGSGGGG SDIQMTQSPS SLSASVGDRV TITCRASQSI SSYLNWYQQK PGKAPKLLIY AASSLQSGVP SGFSGSGSGT DFTLTISSLQ PEDFATYYCQ QSYSTPLTFG GGTKVEIKAA AGSGGSGFVP VFLPAKPTTT PAPRPPTPAP TIASQPLSLR |

TABLE 7-continued

Amino Acid Sequences

| ID No | Component | Sequence |
|---|---|---|
| | | PEACRPAAGG AVHTRGLDFA CDIYIWAPLA GTCGVLLLSL VITLYCNHRN RSKRSRLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |
| 257 | hIgGk-VIII_M912_spCD8_CD28_CD40 | MEAPAQLLFL LLLWLPDTTR QVQLQESGPG LVKPSETLSL TCTVSGGSVS SGSYYWSWIR QPPGKGLEWI GYIYYSGSTN YNPSLKSRVT ISVDTSKNQF SLKLSSVTAA DTAVYYCARE GKNGAFDIWG QGTMVTVSSG GGGSGGGGSG GGGSDIQMTQ SPSSLSASVG DRVTITCRAS QSISSYLNWY QQKPGKAPKL LIYAASSLQS GVPSGFSGSG SGTDFTLTIS SLQPEDFATY YCQQSYSTPL TFGGGTKVEI KAAAGSGGGS FVPVFLPAKP TTTPAPRPPT PAPTIASQPL SLRPEACRPA AGGAVHTRGL DFACDIYIWA PLAGTCGVLL LSLVITLYCN HRNRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 258 | OSM_M912_CD28TM_CD28_CD40 | MGVLLTQRTL LSLVLALLFP SMASMQVQLQ ESGPGLVKPS ETLSLTCTVS GGSVSSGSYY WSWIRQPPGK GLEWIGYIYY SGSTNYNPSL KSRVTISVDT SKNQFSLKLS SVTAADTAVY YCAREGKNGA FDIWGQGTMV TVSSGGGGSG GGGSGGGGSD IQMTQSPSSL SASVGDRVTI TCRASQSISS YLNWYQQKPG KAPKLLIYAA SSLQSGVPSG FSGSGSGTDF TLTISSLQPE DFATYYCQQS YSTPLTFGGG TKVEIKAAAG SGGGSGFWVLV VVGGVLACYS LLVTVAFIIF WVRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 259 | CD8a_M912_CD28TM_CD28_CD40 | MALPVTALLL PLALLLHAAR PQVQLQESGP GLVKPSETLS LTCTVSGGSV SSGSYYWSWI RQPPGKGLEW IGYIYYSGST NYNPSLKSRV TISVDTSKNQ FSLKLSSVTA ADTAVYYCAR EGKNGAFDIW GQGTMVTVSS GGGGSGGGGS GGGGSDIQMT QSPSSLSASV GDRVTITCRA SQSISSYLNW YQQKPGKAPK LLIYAASSLQ SGVPSGFSGS GSGTDFTLTI SSLQPEDFAT YYCQQSYSTP LTFGGGTKVE IKAAGSGGS GFWVLVVVGG VLACYSLLVT VAFIIFWVRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 260 | CD2_M912_CD28TM_CD28_CD40 | MSFPCKFVAS FLLIFNVSSK GAVSQVQLQE SGPGLVKPSE TLSLTCTVSG GSVSSGSYYW SWIRQPPGKG LEWIGYIYYS GSTNYNPSLK SRVTISVDTS KNQFSLKLSS VTAADTAVYY CAREGKNGAF DIWGQGTMVT VSSGGGGSGG GGSGGGGSDI QMTQSPSSLS ASVGDRVTIT CRASQSISSY LNWYQQKPGK APKLLIYAAS SLQSGVPSGF SGSGSGTDFT LTISSLQPED FATYYCQQSY STPLTFGGGT KVEIKAAAGS GGSGFWVLVV VGGVLACYSL LVTVAFIIFW VRSKRSRLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |
| 261 | IL2_M912_CD28TM_CD28_CD40 | MYRMQLLSCI ALSLALVTNS QVQLQESGPG LVKPSETLSL TCTVSGGSVS SGSYYWSWIR QPPGKGLEWI GYIYYSGSTN YNPSLKSRVT ISVDTSKNQF SLKLSSVTAA DTAVYYCARE GKNGAFDIWG QGTMVTVSSG GGGSGGGGSG GGGSDIQMTQ SPSSLSASVG DRVTITCRAS QSISSYLNWY QQKPGKAPKL LIYAASSLQS GVPSGFSGSG SGTDFTLTIS SLQPEDFATY YCQQSYSTPL TFGGGTKVEI KAAAGSGGGS FWVLVVVGGV LACYSLLVTV AFIIFWVRSK RSRLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |
| 262 | GM-CSF_M912_CD28TM_CD28_CD40 | MWLQSLLLLG TVACSISQVQ LQESGPGLVK PSETLSLTCT VSGGSVSSGS YYWSWIRQPP GKGLEWIGYI YYSGSTNYNP SLKSRVTISV DTSKNQFSLK LSSVTAADTA VYYCAREGKN GAFDIWGQGT MVTVSSGGGG SGGGGSGGGG SDIQMTQSPS SLSASVGDRV TITCRASQSI SSYLNWYQQK PGKAPKLLIY AASSLQSGVP SGFSGSGSGT DFTLTISSLQ PEDFATYYCQ QSYSTPLTFG GGTKVEIKAA AGSGGGSGFWV LVVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 263 | hIgGk-VIII_M912_CD28TM_CD28_CD40 | MEAPAQLLFL LLLWLPDTTR QVQLQESGPG LVKPSETLSL TCTVSGGSVS SGSYYWSWIR QPPGKGLEWI GYIYYSGSTN YNPSLKSRVT ISVDTSKNQF SLKLSSVTAA DTAVYYCARE GKNGAFDIWG QGTMVTVSSG GGGSGGGGSG GGGSDIQMTQ SPSSLSASVG DRVTITCRAS QSISSYLNWY QQKPGKAPKL LIYAASSLQS GVPSGFSGSG SGTDFTLTIS SLQPEDFATY YCQQSYSTPL TFGGGTKVEI KAAAGSGGGS FWVLVVVGGV LACYSLLVTV AFIIFWVRSK RSRLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |

TABLE 7-continued

Amino Acid Sequences

| ID No | Component | Sequence |
|---|---|---|
| 264 | OSM_HuYP2 18_spCD28_CD28_CD4 0 CTP228 | MGVLLTQRTL LSLVLALLFP SMASMEVQLV ESGGGLVQPG GSLRLSCAAS GFDLGFYFYA CWVRQAPGKG LEWVSCIYTA GSGSTYYASW AKGRFTISRD NSKNTLYLQM NSLRAEDTAV YYCARSTANT RSTYYLNLWG QGTLVTVSSG GGGSGGGGSG GGGSDIQMTQ SPSSLSASVG DRVTITCQAS QRISSYLSWY QQKPGKVPKL LIYGASTLAS GVPSRFSGSG SGTDFTLTIS SLQPEDVATY YCQSYAYFDS NNWHAFGGGT KVEIAAAGSG GSILVKQSP MLVAYDNAVN LSCKYSYNLF SREFRASLHK GLDSAVEVCV VYGNYSQQLQ VYSKTGFNCD GKLGNESVTF YLQNLYVNQT DIYFCKIEVM YPPPYLDNEK SNGTIIHVKG KHLCPSPLFP GPSKPFWVLV VVGGVLACYS LLVTVAFIIF WVRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 265 | CD8a_HuYP 218_spCD28_CD28_CD4 0 | MALPVTALLL PLALLLHAAR PEVQLVESGG GLVQPGGSLR LSCAASGFDL GFYFYACWVR QAPGKGLEWV SCIYTAGSGS TYYASWAKGR FTISRDNSKN TLYLQMNSLR AEDTAVYYCA RSTANTRSTY YLNLWGQGTL VTVSSGGGGS GGGGSGGGGS DIQMTQSPSS LSASVGDRVT ITCQASQRIS SYLSWYQQKP GKVPKLLIYG ASTLASGVPS RFSGSGSGTD FTLTISSLQP EDVATYYCQS YAYFDSNNWH AFGGGTKVEI AAAGSGGSGI LVKQSPMLVA YDNAVNLSCK YSYNLFSREF RASLHKGLDS AVEVCVVYGN YSQQLQVYSK TGFNCDGKLG NESVTFYLQN LYVNQTDIYF CKIEVMYPPP YLDNEKSNGT IIHVKGKHLC PSPLFPGPSK PFWVLVVGG VLACYSLLVT VAFIIFWVRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 266 | CD2_HuYP2 18_spCD28_CD28_CD4 0 | MSFPCKFVAS FLLIFNVSSK GAVSEVQLVE SGGGLVQPGG SLRLSCAASG FDLGFYFYAC WVRQAPGKGL EWVSCIYTAG SGSTYYASWA KGRFTISRDN SKNTLYLQMN SLRAEDTAVY YCARSTANTR STYYLNLWGQ GTLVTVSSGG GGSGGGGSGG GGSDIQMTQS PSSLSASVGD RVTITCQASQ RISSYLSWYQ QKPGKVPKLL IYGASTLASG VPSRFSGSGS GTDFTLTISS LQPEDVATYY CQSYAYFDSN NWHAFGGGTK VEIAAAGSGG SGILVKQSPM LVAYDNAVNL SCKYSYNLFS REFRASLHKG LDSAVEVCVV YGNYSQQLQV YSKTGFNCDG KLGNESVTFY LQNLYVNQTD IYFCKIEVMY PPPYLDNEKS NGTIIHVKGK HLCPSPLFPG PSKPFWVLVV VGGVLACYSL LVTVAFIIFW VRSKRSRLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |
| 267 | IL2_HuYP2 18_spCD28_CD28_CD4 0 | MYRMQLLSCI ALSLALVTNS EVQLVESGGG LVQPGGSLRL SCAASGFDLG FYFYACWVRQ APGKGLEWVS CIYTAGSGST YYASWAKGRF TISRDNSKNT LYLQMNSLRA EDTAVYYCAR STANTRSTYY LNLWGQGTLV TVSSGGGGSG GGGSGGGGSD IQMTQSPSSL SASVGDRVTI TCQASQRISS YLSWYQQKPG KVPKLLIYGA STLASGVPSR FSGSGSGTDF TLTISSLQPE DVATYYCQSY AYFDSNNWHA FGGGTKVEIA AAGSGGSGIL VKQSPMLVAY DNAVNLSCKY SYNLFSREFR ASLHKGLDSA VEVCVVYGNY SQQLQVYSKT GFNCDGKLGN ESVTFYLQNL YVNQTDIYFC KIEVMYPPPY LDNEKSNGTI IHVKGKHLCP SPLFPGPSKP FWVLVVGGV LACYSLLVTV AFIIFWVRSK RSRLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |
| 268 | GM-CSF_HuYP2 18_spCD28_CD28_CD4 0 | MWLQSLLLLG TVACSISEVQ LVESGGGLVQ PGGSLRLSCA ASGFDLGFYF YACWVRQAPG KGLEWVSCIY TAGSGSTYYA SWAKGRFTIS RDNSKNTLYL QMNSLRAEDT AVYYCARSTA NTRSTYYLNL WGQGTLVTVS SGGGGSGGGG SGGGGSDIQM TQSPSSLSAS VGDRVTITCQ ASQRISSYLS WYQQKPGKVP KLLIYGASTL ASGVPSRFSG SGSGTDFTLT ISSLQPEDVA TYYCQSYAYF DSNNWHAFGG GTKVEIAAAG SGGSGILVKQ SPMLVAYDNA VNLSCKYSYN LFSREFRASL HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 269 | hIgGk-VIII_HuYP218_spCD28_CD28_CD4 0 | MEAPAQLLFL LLLWLPDTTR EVQLVESGGG LVQPGGSLRL SCAASGFDLG FYFYACWVRQ APGKGLEWVS GIYTAGSGST YYASWAKGRF TISRDNSKNT LYLQMNSLRA EDTAVYYCAR STANTRSTYY LNLWGQGTLV TVSSGGGGSG GGGSGGGGSD IQMTQSPSSL SASVGDRVTI TCQASQRISS YLSWYQQKPG KVPKLLIYGA STLASGVPSR FSGSGSGTDF TLTISSLQPE DVATYYCQSY AYFDSNNWHA FGGGTKVEIA AAGSGGSGIL VKQSPMLVAY DNAVNLSCKY SYNLFSREFR ASLHKGLDSA VEVCVVYGNY SQQLQVYSKT GFNCDGKLGN ESVTFYLQNL YVNQTDIYFC KIEVMYPPPY LDNEKSNGTI IHVKGKHLCP SPLFPGPSKP FWVLVVGGV LACYSLLVTV AFIIFWVRSK RSRLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |

TABLE 7-continued

Amino Acid Sequences

| ID No | Component | Sequence |
|---|---|---|
| 270 | OSM_HuYP218_spCD8_CD28_CD40_CTP240 | MGVLLTQRTL LSLVLALLFP SMASMEVQLV ESGGGLVQPG GSLRLSCAAS GFDLGFYFYA CWVRQAPGKG LEWVSCIYTA GSGSTYYASW AKGRFTISRD NSKNTLYLQM NSLRAEDTAV YYCARSTANT RSTYYLNLWG QGTLVTVSSG GGGSGGGGSG GGGSDIQMTQ SPSSLSASVG DRVTITCQAS QRISSYLSWY QQKPGKVPKL LIYGASTLAS GVPSRFSGSG SGTDFTLTIS SLQPEDVATY YCQSYAYFDS NNWHAFGGGT KVEIAAAGSG GSGFVPVFLP AKPTTTPAPR PPTPAPTIAS QPLSLRPEAC RPAAGGAVHT RGLDFACDIY IWAPLAGTCG VLLLSLVITL YCNHRNRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |
| 271 | CD8a_HuYP218_spCD8_CD28_CD40 | MALPVTALLL PLALLLHAAR PEVQLVESGG GLVQPGGSLR LSCAASGFDL GFYFYACWVR QAPGKGLEWV SCIYTAGSGS TYYASWAKGR FTISRDNSKN TLYLQMNSLR AEDTAVYYCA RSTANTRSTY YLNLWGQGTL VTVSSGGGGS GGGGSGGGGS DIQMTQSPSS LSASVGDRVT ITCQASQRIS SYLSWYQQKP GKVPKLLIYG ASTLASGVPS RFSGSGSGTD FTLTISSLQP EDVATYYCQS YAYFDSNNWH AFGGGTKVEI AAAGSGGSGF VPVFLPAKPT TTPAPRPPTP APTIASQPLS LRPEACRPAA GGAVHTRGLD FACDIYIWAP LAGTCGVLLL SLVITLYCNH RNRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 272 | CD2_HuYP218_spCD8_CD28_CD40 | MSFPCKFVAS FLLIFNVSSK GAVSEVQLVE SGGGLVQPGG SLRLSCAASG FDLGFYFYAC WVRQAPGKGL EWVSCIYTAG SGSTYYASWA KGRFTISRDN SKNTLYLQMN SLRAEDTAVY YCARSTANTR STYYLNLWGQ GTLVTVSSGG GGSGGGGSGG GGSDIQMTQS PSSLSASVGD RVTITCQASQ RISSYLSWYQ QKPGKVPKLL IYGASTLASG VPSRFSGSGS GTDFTLTISS LQPEDVATYY CQSYAYFDSN NWHAFGGGTK VEIAAAGSGG SGFVPVFLPA KPTTTPAPRP PTPAPTIASQ PLSLRPEACR PAAGGAVHTR GLDFACDIYI WAPLAGTCGV LLLSLVITLY CNHRNRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 273 | IL2_HuYP218_spCD8_CD28_CD40 | MYRMQLLSCI ALSLALVTNS EVQLVESGGG LVQPGGSLRL SCAASGFDLG FYFYACWVRQ APGKGLEWVS GIYTAGSGST YYASWAKGRF TISRDNSKNT LYLQMNSLRA EDTAVYYCAR STANTRSTYY LNLWGQGTLV TVSSGGGGSG GGGSGGGGSD IQMTQSPSSL SASVGDRVTI TCQASQRISS YLSWYQQKPG KVPKLLIYGA STLASGVPSR FSGSGSGTDF TLTISSLQPE DVATYYCQSY AYFDSNNWHA FGGGTKVEIA AAGSGGSGFV PVFLPAKPTT TPAPRPPTPA PTIASQPLSL RPEACRPAAG GAVHTRGLDF ACDIYIWAPL AGTCGVLLLS LVITLYCNHR NRSKRSRLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |
| 274 | GM-CSF_HuYP218_spCD8_CD28_CD40 | MWLQSLLLLG TVACSISEVQ LVESGGGLVQ PGGSLRLSCA ASGFDLGFYF YACWVRQAPG KGLEWVSCIY TAGSGSTYYA SWAKGRFTIS RDNSKNTLYL QMNSLRAEDT AVYYCARSTA NTRSTYYLNL WGQGTLVTVS SGGGGSGGGG SGGGGSDIQM TQSPSSLSAS VGDRVTITCQ ASQRISSYLS WYQQKPGKVP KLLIYGASTL ASGVPSRFSG SGSGTDFTLT ISSLQPEDVA TYYCQSYAYF DSNNWHAFGG GTKVEIAAAG SGGSGFVPVF LPAKPTTTPA PRPPTPAPTI ASQPLSLRPE ACRPAAGGAV HTRGLDFACD IYIWAPLAGT CGVLLLSLVI TLYCNHRNRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 275 | hIgGk-VIII_HuYP218_spCD8_CD28_CD40 | MEAPAQLLFL LLLWLPDTTR EVQLVESGGG LVQPGGSLRL SCAASGFDLG FYFYACWVRQ APGKGLEWVS CIYTAGSGST YYASWAKGRF TISRDNSKNT LYLQMNSLRA EDTAVYYCAR STANTRSTYY LNLWGQGTLV TVSSGGGGSG GGGSGGGGSD IQMTQSPSSL SASVGDRVTI TCQASQRISS YLSWYQQKPG KVPKLLIYGA STLASGVPSR FSGSGSGTDF TLTISSLQPE DVATYYCQSY AYFDSNNWHA FGGGTKVEIA AAGSGGSGFV PVFLPAKPTT TPAPRPPTPA PTIASQPLSL RPEACRPAAG GAVHTRGLDF ACDIYIWAPL AGTCGVLLLS LVITLYCNHR NRSKRSRLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |
| 276 | OSM_HuYP218_CD28TM_CD28_CD40 | MGVLLTQRTL LSLVLALLFP SMASMEVQLV ESGGGLVQPG GSLRLSCAAS GFDLGFYFYA CWVRQAPGKG LEWVSCIYTA GSGSTYYASW AKGRFTISRD NSKNTLYLQM NSLRAEDTAV YYCARSTANT RSTYYLNLWG QGTLVTVSSG GGGSGGGGSG GGGSDIQMTQ SPSSLSASVG DRVTITCQAS QRISSYLSWY QQKPGKVPKL LIYGASTLAS GVPSRFSGSG SGTDFTLTIS SLQPEDVATY YCQSYAYFDS NNWHAFGGGT KVEIAAAGSG GSGFWVLVVV GGVLACYSLL |

TABLE 7-continued

Amino Acid Sequences

| ID No | Component | Sequence |
|---|---|---|
| | | VTVAFIIFWV RSKRSRLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |
| 277 | CD8a_HuYP 218_CD28TM _CD28_CD40 | MALPVTALLL PLALLLLHAAR PEVQLVESGG GLVQPGGSLR LSCAASGFDL GFYFYACWVR QAPGKGLEWV SCIYTAGSGS TYYASWAKGR FTISRDNSKN TLYLQMNSLR AEDTAVYYCA RSTANTRSTY YLNLWGQGTL VTVSSGGGGS GGGGSGGGGS DIQMTQSPSS LSASVGDRVT ITCQASQRIS SYLSWYQQKP GKVPKLLIYG ASTLASGVPS RFSGSGSGTD FTLTISSLQP EDVATYYCQS YAYFDSNNWH AFGGGTKVEI AAAGSGGSGF WVLVVVGGVL ACYSLLVTVA FIIFWVRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |
| 278 | CD2_HuYP2 18_CD28TM _CD28_CD40 | MSFPCKFVAS FLLIFNVSSK GAVSEVQLVE SGGGLVQPGG SLRLSCAASG FDLGFYFYAC WVRQAPGKGL EWVSCIYTAG SGSTYYASWA KGRFTISRDN SKNTLYLQMN SLRAEDTAVY YCARSTANTR STYYLNLWGQ GTLVTVSSGG GGSGGGGSGG GGSDIQMTQS PSSLSASVGD RVTITCQASQ RISSYLSWYQ QKPGKVPKLL IYGASTLASG VPSRFSGSGS GTDFTLTISS LQPEDVATYY CQSYAYFDSN NWHAFGGGTK VEIAAAGSGG SGFWVLVVVG GVLACYSLLV TVAFIIFWVR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 279 | IL2_HuYP2 18_CD28TM _CD28_CD40 | MYRMQLLSCI ALSLALVTNS EVQLVESGGG LVQPGGSLRL SCAASGFDLG FYFYACWVRQ APGKGLEWVS CIYTAGSGST YYASWAKGRF TISRDNSKNT LYLQMNSLRA EDTAVYYCAR STANTRSTYY LNLWGQGTLV TVSSGGGGSG GGGSGGGGSD IQMTQSPSSL SASVGDRVTI TCQASQRISS YLSWYQQKPG KVPKLLIYGA STLASGVPSR FSGSGSGTDF TLTISSLQPE DVATYYCQSY AYFDSNNWHA FGGGTKVEIA AAGSGGSGFW VLVVVGGVLA CYSLLVTVAF IIFWVRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 280 | GM-CSF_HuYP2 18_CD28TM _CD28_CD40 | MWLQSLLLLG TVACSISEVQ LVESGGGLVQ PGGSLRLSCA ASGFDLGFYF YACWVRQAPG KGLEWVSCIY TAGSGSTYYA SWAKGRFTIS RDNSKNTLYL QMNSLRAEDT AVYYCARSTA NTRSTYYLNL WGQGTLVTVS SGGGGSGGGG SGGGGSDIQM TQSPSSLSAS VGDRVTITCQ ASQRISSYLS WYQQKPGKVP KLLIYGASTL ASGVPSRFSG SGSGTDFTLT ISSLQPEDVA TYYCQSYAYF DSNNWHAFGG GTKVEIAAAG SGGSGFWVLV VVGGVLACYS LLVTVAFIIF WVRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 281 | hIgGk-VIII_HuYP218 _CD28TM _CD28_CD40 | MEAPAQLLFL LLLWLPDTTR EVQLVESGGG LVQPGGSLRL SCAASGFDLG FYFYACWVRQ APGKGLEWVS CIYTAGSGST YYASWAKGRF TISRDNSKNT LYLQMNSLRA EDTAVYYCAR STANTRSTYY LNLWGQGTLV TVSSGGGGSG GGGSGGGGSD IQMTQSPSSL SASVGDRVTI TCQASQRISS YLSWYQQKPG KVPKLLIYGA STLASGVPSR FSGSGSGTDF TLTISSLQPE DVATYYCQSY AYFDSNNWHA FGGGTKVEIA AAGSGGSGFW VLVVVGGVLA CYSLLVTVAF IIFWVRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 282 | OSM_P4 _spCD28 _CD28_CD40 CTP229 | MGVLLTQRTL LSLVLALLFP SMASMQVQLQ QSGPGLVTPS QTLSLTCAIS GDSVSSNSAT WNWIRQSPSR GLEWLGRTYY RSKWYNDYAV SVKSRMSINP DTSKNQFSLQ LNSVTPEDTA VYYCARGMMT YYYGMDVWGQ GTTVTVSSGG GGSGGGGSGG GGSQPVLTQS SSLSASPGAS ASLTCTLRSG INVGPYRIYW YQQKPGSPPQ YLLNYKSDSD KQQGSGVPSR FSGSKDASAN AGVLLISGLR SEDEADYYCM IWHSSAAVFG GGTQLTVLSA AAGSGGSGIL VKQSPMLVAY DNAVNLSCKY SYNLFSREPR ASLHKGLDSA VEVCVVYGNY SQQLQVYSKT GFNCDGKLGN ESVTFYLQNL YVNQTDIYFC KIEVMYPPPY LDNEKSNGTI IHVKGKHLCP SPLFPGPSKP FWVLVVVGGV LACYSLLVTV AFIIFWVRSK RSRLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |
| 283 | CD8a_P4 _spCD28 _CD28_CD40 | MALPVTALLL PLALLLLHAAR PQVQLQQSGP GLVTPSQTLS LTCAISGDSV SSNSATWNWI RQSPSRGLEW LGRTYYRSKW YNDYAVSVKS RMSINPDTSK NQFSLQLNSV TPEDTAVYYC ARGMMTYYYG MDVWGQGTTV TVSSGGGGSG GGGSGGGGSQ PVLTQSSSLS ASPGASASLT CTLRSGINVG PYRIYWYQQK PGSPPQYLLN YKSDSDKQQG SGVPSRFSGS KDASANAGVL LISGLRSEDE ADYYCMIWHS SAAVFGGGTQ LTVLSAAAGS GGSGILVKQS PMLVAYDNAV NLSCKYSYNL FSREFRASLH KGLDSAVEVC VVYGNYSQQL QVYSKTGFNC DGKLGNESVT FYLQNLYVNQ TDIYFCKIEV MYPPPYLDNE KSNGTIIHVK GKHLCPSPLF PGPSKPFWVL VVVGGVLACY SLLVTVAFII FWVRSKRSRL |

TABLE 7-continued

Amino Acid Sequences

| ID No | Component | Sequence |
|---|---|---|
| | | LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 284 | CD2_P4_spCD28_CD28_CD4 0 | MSFPCKFVAS FLLIFNVSSK GAVSQVQLQQ SGPGLVTPSQ TLSLTCAISG DSVSSNSATW NWIRQSPSRG LEWLGRTYYR SKWYNDYAVS VKSRMSINPD TSKNQFSLQL NSVTPEDTAV YYCARGMMTY YYGMDVWGQG TTVTVSSGGG GSGGGGSGGG GSQPVLTQSS SLSASPGASA SLTCTLRSGI NVGPYRIYWY QQKPGSPPQY LLNYKSDSDK QQGSGVPSRF SGSKDASANA GVLLISGLRS EDEADYYCMI WHSSAAVFGG GTQLTVLSAA AGSGGSGILV KQSPMLVAYD NAVNLSCKYS YNLFSREFRA SLHKGLDSAV EVCVVYGNYS QQLQVYSKTG FNCDGKLGNE SVTFYLQNLY VNQTDIYFCK IEVMYPPPYL DNEKSNGTII HVKGKHLCPS PLFPGPSKPF WVLVVVGGVL ACYSLLVTVA FIIFWVRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |
| 285 | IL2_P4_spCD28_CD28_CD4 0 | MYRMQLLSCI ALSLALVTNS QVQLQQSGPG LVTPSQTLSL TCAISGDSVS SNSATWNWIR QSPSRGLEWL GRTYYRSKWY NDYAVSVKSR MSINPDTSKN QFSLQLNSVT PEDTAVYYCA RGMMTYYYGM DVWGQGTTVT VSSGGGGSGG GGSGGGGSQP VLTQSSSLSA SPGASASLTC TLRSGINVGP YRIYWYQQKP GSPPQYLLNY KSDSDKQQGS GVPSRFSGSK DASANAGVLL ISGLRSEDEA DYYCMIWHSS AAVFGGGTQL TVLSAAAGSG GSGILVKQSP MLVAYDNAVN LSCKYSYNLF SREFRASLHK GLDSAVEVCV VYGNYSQQLQ VYSKTGFNCD GKLGNESVTF YLQNLYVNQT DIYFCKIEVM YPPPYLDNEK SNGTIIHVKG KHLCPSPLFP GPSKPFWVLV VVGGVLACYS LLVTVAFIIF WVRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 286 | GM-CSF_P4_spCD28_CD28_CD4 0 | MWLQSLLLLG TVACSISQVQ LQQSGPGLVT PSQTLSLTCA ISGDSVSSNS ATWNWIRQSP SRGLEWLGRT YYRSKWYNDY AVSVKSRMSI NPDTSKNQFS LQLNSVTPED TAVYYCARGM MTYYYGMDVW GQGTTVTVSS GGGGSGGGGS GGGGSQPVLT QSSSLSASPG ASASLTCTLR SGINVGPYRI YWYQQKPGSP PQYLLNYKSD SDKQQGSGVP SRFSGSKDAS ANAGVLLISG LRSEDEADYY CMIWHSSAAV FGGGTQLTVL SAAAGSGGSG ILVKQSPMLV AYDNAVNLSC KYSYNLFSRE FRASLHKGLD SAVEVCVVYG NYSQQLQVYS KTGFNCDGKL GNESVTFYLQ NLYVNQTDIY FCKIEVMYPP PYLDNEKSNG TIIHVKGKHL CPSPLFPGPS KPFWVLVVVG GVLACYSLLV TVAFIIFWVR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 287 | hIgGk-VIII_P4_spCD28_CD28_CD4 0 | MEAPAQLLFL LLLWLPDTTR QVQLQQSGPG LVTPSQTLSL TCAISGDSVS SNSATWNWIR QSPSRGLEWL GRTYYRSKWY NDYAVSVKSR MSINPDTSKN QFSLQLNSVT PEDTAVYYCA RGMMTYYYGM DVWGQGTTVT VSSGGGGSGG GGSGGGGSQP VLTQSSSLSA SPGASASLTC TLRSGINVGP YRIYWYQQKP GSPPQYLLNY KSDSDKQQGS GVPSRFSGSK DASANAGVLL ISGLRSEDEA DYYCMIWHSS AAVFGGGTQL TVLSAAAGSG GSGILVKQSP MLVAYDNAVN LSCKYSYNLF SREFRASLHK GLDSAVEVCV VYGNYSQQLQ VYSKTGFNCD GKLGNESVTF YLQNLYVNQT DIYFCKIEVM YPPPYLDNEK SNGTIIHVKG KHLCPSPLFP GPSKPFWVLV VVGGVLACYS LLVTVAFIIF WVRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 288 | OSM_P4_spCD8_CD28_CD4 0 CTP241 | MGVLLTQRTL LSLVLALLFP SMASMQVQLQ QSGPGLVTPS QTLSLTCAIS GDSVSSNSAT WNWIRQSPSR GLEWLGRTYY RSKWYNDYAV SVKSRMSINP DTSKNQFSLQ LNSVTPEDTA VYYCARGMMT YYYGMDVWGQ GTTVTVSSGG GGSGGGGSGG GGSQPVLTQS SSLSASPGAS ASLTCTLRSG INVGPYRIYW YQQKPGSPPQ YLLNYKSDSD KQQGSGVPSR FSGSKDASAN AGVLLISGLR SEDEADYYCM IWHSSAAVFG GGTQLTVLSA AAGSGGSGFV PVFLPAKPTT TPAPRPPTPA PTIASQPLSL RPEACRPAAG GAVHTRGLDF ACDIYIWAPL AGTCGVLLLS LVITLYCNHR NRSKRSLLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |
| 289 | CD8a_P4_spCD8_CD28_CD4 0 | MALPVTALLL PLALLLHAAR PQVQLQQSGP GLVTPSQTLS LTCAISGDSV SSNSATWNWI RQSPSRGLEW LGRTYYRSKW YNDYAVSVKS RMSINPDTSK NQFSLQLNSV TPEDTAVYYC ARGMMTYYYG MDVWGQGTTV TVSSGGGGSG GGGSGGGGSQ PVLTQSSSLS ASPGASASLT CTLRSGINVG PYRIYWYQQK PGSPPQYLLN YKSDSDKQQG SGVPSRFSGS KDASANAGVL LISGLRSEDE ADYYCMIWHS SAAVFGGGTQ LTVLSAAAGS GGSGFVPVFL PAKPTTTPAP RPPTPAPTIA SQPLSLRPEA CRPAAGGAVH TRGLDFACDI YIWAPLAGTC GVLLLSLVIT LYCNHRNRSK RSLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |

TABLE 7-continued

Amino Acid Sequences

| ID No | Component | Sequence |
|---|---|---|
| 290 | CD2_P4_spCD8_CD28_CD40 | MSFPCKFVAS FLLIFNVSSK GAVSQVQLQQ SGPGLVTPSQ TLSLTCAISG DSVSSNSATW NWIRQSPSRG LEWLGRTYYR SKWYNDYAVS VKSRMSINPD TSKNQFSLQL NSVTPEDTAV YYCARGMMTY YYGMDVWGQG TTVTVSSGGG GSGGGGSGGG GSQPVLTQSS SLSASPGASA SLTCTLRSGI NVGPYRIYWY QQKPGSPPQY LLNYKSDSDK QQGSGVPSRF SGSKDASANA GVLLISGLRS EDEADYYCMI WHSSAAVFGG GTQLTVLSAA AGSGGSGFVP VFLPAKPTTT PAPRPPTPAP TIASQPLSLR PEACRPAAGG AVHTRGLDFA CDIYIWAPLA GTCGVLLLSL VITLYCNHRN RSKRSLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |
| 291 | IL2_P4_spCD8_CD28_CD40 | MYRMQLLSCI ALSLALVTNS QVQLQQSGPG LVTPSQTLSL TCAISGDSVS SNSATWNWIR QSPSRGLEWL GRTYYRSKWY NDYAVSVKSR MSINPDTSKN QFSLQLNSVT PEDTAVYYCA RGMMTYYYGM DVWGQGTTVT VSSGGGGSGG GGSGGGGSQP VLTQSSSLSA SPGASASLTC TLRSGINVGP YRIYWYQQKP GSPPQYLLNY KSDSDKQQGS GVPSRFSGSK DASANAGVLL ISGLRSEDEA DYYCMIWHSS AAVFGGGTQL TVLSAAAGSG GSGFVPVFLP AKPTTTPAPR PPTPAPTIAS QPLSLRPEAC RPAAGGAVHT RGLDFACDIY IWAPLAGTCG VLLLSLVITL YCNHRNRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |
| 292 | GM-CSF_P4_spCD8_CD28_CD40 | MWLQSLLLLG TVACSISQVQ LQQSGPGLVT PSQTLSLTCA ISGDSVSSNS ATWNWIRQSP SRGLEWLGRT YYRSKWYNDY AVSVKSRMSI NPDTSKNQFS LQLNSVTPED TAVYYCARGM MTYYYGMDVW GQGTTVTVSS GGGGSGGGGS GGGGSQPVLT QSSSLSASPG ASASLTCTLR SGINVGPYRI YWYQQKPGSP PQYLLNYKSD SDKQQGSGVP SRFSGSKDAS ANAGVLLISG LRSEDEADYY CMIWHSSAAV FGGGTQLTVL SAAAGSGGSG FVPVFLPAKP TTTPAPRPPT PAPTIASQPL SLRPEACRPA AGGAVHTRGL DFACDIYIWA PLAGTCGVLL LSLVITLYCN HRNRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 293 | hIgGk-VIII_P4_spCD8_CD28_CD40 | MEAPAQLLFL LLLWLPDTTR QVQLQQSGPG LVTPSQTLSL TCAISGDSVS SNSATWNWIR QSPSRGLEWL GRTYYRSKWY NDYAVSVKSR MSINPDTSKN QFSLQLNSVT PEDTAVYYCA RGMMTYYYGM DVWGQGTTVT VSSGGGGSGG GGSGGGGSQP VLTQSSSLSA SPGASASLTC TLRSGINVGP YRIYWYQQKP GSPPQYLLNY KSDSDKQQGS GVPSRFSGSK DASANAGVLL ISGLRSEDEA DYYCMIWHSS AAVFGGGTQL TVLSAAAGSG GSGFVPVFLP AKPTTTPAPR PPTPAPTIAS QPLSLRPEAC RPAAGGAVHT RGLDFACDIY IWAPLAGTCG VLLLSLVITL YCNHRNRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |
| 294 | OSM_P4_CD28TM_CD28_CD40 | MGVLLTQRTL LSLVLALLFP SMASMQVQLQ QSGPGLVTPS QTLSLTCAIS GDSVSSNSAT WNWIRQSPSR GLEWLGRTYY RSKWYNDYAV SVKSRMSINP DTSKNQFSLQ LNSVTPEDTA VYYCARGMMT YYYGMDVWGQ GTTVTVSSGG GGSGGGGSGG GGSQPVLTQS SSLSASPGAS ASLTCTLRSG INVGPYRIYW YQQKPGSPPQ YLLNYKSDSD KQQGSGVPSR FSGSKDASAN AGVLLISGLR SEDEADYYCM IWHSSAAVFG GGTQLTVLSA AAGSGGSGFW VLVVGGVLA CYSLLVTVAF IIFWVRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 295 | CD8a_P4_CD28TM_CD28_CD40 | MALPVTALLL PLALLLHAAR PQVQLQQSGP GLVTPSQTLS LTCAISGDSV SSNSATWNWI RQSPSRGLEW LGRTYYRSKW YNDYAVSVKS RMSINPDTSK NQFSLQLNSV TPEDTAVYYC ARGMMTYYYG MDVWGQGTTV TVSSGGGGSG GGGSGGGGSQ PVLTQSSSLS ASPGASASLT CTLRSGINVG PYRIYWYQQK PGSPPQYLLN YKSDSDKQQG SGVPSRFSGS KDASANAGVL LISGLRSEDE ADYYCMIWHS SAAVFGGGTQ LTVLSAAAGS GGSGFWVLVV VGGVLACYSL LVTVAFIIFW VRSKRSRLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |
| 296 | CD2_P4_CD28TM_CD28_CD40 | MSFPCKFVAS FLLIFNVSSK GAVSQVQLQQ SGPGLVTPSQ TLSLTCAISG DSVSSNSATW NWIRQSPSRG LEWLGRTYYR SKWYNDYAVS VKSRMSINPD TSKNQFSLQL NSVTPEDTAV YYCARGMMTY YYGMDVWGQG TTVTVSSGGG GSGGGGSGGG GSQPVLTQSS SLSASPGASA SLTCTLRSGI NVGPYRIYWY QQKPGSPPQY LLNYKSDSDK QQGSGVPSRF SGSKDASANA GVLLISGLRS EDEADYYCMI WHSSAAVFGG GTQLTVLSAA AGSGGSGFWV LVVGGVLAC YSLLVTVAFI IFWVRSKRS LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |

TABLE 7-continued

Amino Acid Sequences

| ID No | Component | Sequence |
|---|---|---|
| 297 | IL2_P4_CD28TM_CD28_CD40 | MYRMQLLSCI ALSLALVTNS QVQLQQSGPG LVTPSQTLSL TCAISGDSVS SNSATWNWIR QSPSRGLEWL GRTYYRSKWY NDYAVSVKSR MSINPDTSKN QFSLQLNSVT PEDTAVYYCA RGMMTYYYGM DVWGQGTTVT VSSGGGGSGG GSPPQYLLNY KSDSDKQQGS GVPSRFSGSK DASANAGVLL ISGLRSEDEA DYYCMIWHSS AAVFGGGTQL TVLSAAAGSG GSGFWVLVVV GGVLACYSLL VTVAFIIFWV RSKRSLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |
| 298 | GM-CSF_P4_CD28TM_CD28_CD40 | MWLQSLLLLG TVACSISQVQ LQQSGPGLVT PSQTLSLTCA ISGDSVSSNS ATWNWIRQSP SRGLEWLGRT YYRSKWYNDY AVSVKSRMSI NPDTSKNQFS LQLNSVTPED TAVYYCARGM MTYYYGMDVW GQGTTVTVSS GGGGSGGGGS GGGGSQPVLT QSSSLSASPG ASASLTCTLR SGINVGPYRI YWYQQKPGSP PQYLLNYKSD SDKQQGSGVP SRFSGSKDAS ANAGVLLISG LRSEDEADYY CMIWHSSAAV FGGGTQLTVL SAAAGSGGSG FWVLVVVGGV LACYSLLVTV AFIIFWVRSK RSLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |
| 299 | hIgGk-VIII_P4_CD28TM_CD28_CD40 | MEAPAQLLFL LLLWLPDTTR QVQLQQSGPG LVTPSQTLSL TCAISGDSVS SNSATWNWIR QSPSRGLEWL GRTYYRSKWY NDYAVSVKSR MSINPDTSKN QFSLQLNSVT PEDTAVYYCA RGMMTYYYGM DVWGQGTTVT VSSGGGGSGG GSGGGGSQP VLTQSSSLSA SPGASASLTC TLRSGINVGP YRIYWYQQKP GSPPQYLLNY KSDSDKQQGS GVPSRFSGSK DASANAGVLL ISGLRSEDEA DYYCMIWHSS AAVFGGGTQL TVLSAAAGSG GSGFWVLVVV GGVLACYSLL VTVAFIIFWV RSKRSLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |
| 300 | OSM_SS1_spCD28(trun)_CD28_CD40 CTP248 | MGVLLTQRTL LSLVLALLFP SMASMQVQLQ QSGPELEKPG ASVKLSCKAS GYSFTGYTMN WVKQSHGKSL EWIGLITPYN GASSYNQKFR GKATLTVDKS SSTAYMDLLS LTSEDSAVYF CARGGYDGRG FDYWGQGTTV TVSSGGGGSG GGGSGGGGSD IELTQSPAIM SASPGEKVTM TCSASSSVSY MHWYQQKSGT SPKRWIYDTS KLASGVPGRF SGSGSGNSYS LTISSVEAED DATYYCQQWS KHPLTFGAGT KLEIKAAAGS GGSGIIHVKG KHLCPSPLFP GPSKPFWVLV VVGGVLACYS LLVTVAFIIF WVRSKRSLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 301 | CD8a_SS1_spCD28(trun)_CD28_CD40 | MALPVTALLL PLALLLHAAR PQVQLQQSGP ELEKPGASVK LSCKASGYSF TGYTMNWVKQ SHGKSLEWIG LITPYNGASS YNQKFRGKAT LTVDKSSSTA YMDLLSLTSE DSAVYFCARG GYDGRGFDYW GQGTTVTVSS GGGGSGGGGS GGGGSDIELT QSPAIMSASP GEKVTMTCSA SSSVSYMHWY QQKSGTSPKR WIYDTSKLAS GVPGRFSGSG SGNSYSLTIS SVEAEDDATY YCQQWSKHPL TFGAGTKLEI KAAAGSGGSG IIHVKGKHLC PSPLFPGPSK PFWVLVVVGG VLACYSLLVT VAFIIFWVRS KRSLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 302 | CD2_SS1_spCD28(trun)_CD28_CD40 | MSFPCKFVAS FLLIFNVSSK GAVSQVQLQQ SGPELEKPGA SVKLSCKASG YSFTGYTMNW VKQSHGKSLE WIGLITPYNG ASSYNQKFRG KATLTVDKSS STAYMDLLSL TSEDSAVYFC ARGGYDGRGF DYWGQGTTVT VSSGGGGSGG GGSGGGGSDI ELTQSPAIMS ASPGEKVTMT CSASSSVSYM HWYQQKSGTS PKRWIYDTSK LASGVPGRFS GSGSGNSYSL TISSVEAEDD ATYYCQQWSK HPLTFGAGTK LEIKAAAGSG GSGIIHVKGK HLCPSPLFPG PSKPFWVLVV VGGVLACYSL LVTVAFIIFW VRSKRSLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |
| 303 | IL2_SS1_spCD28(trun)_CD28_CD40 | MYRMQLLSCI ALSLALVTNS QVQLQQSGPE LEKPGASVKL SCKASGYSFT GYTMNWVKQS HGKSLEWIGL ITPYNGASSY NQKFRGKATL TVDKSSSTAY MDLLSLTSED SAVYFCARGG YDGRGFDYWG QGTTVTVSSG GGGSGGGGSG GGGSDIELTQ SPAIMSASPG EKVTMTCSAS SSVSYMHWYQ QKSGTSPKRW IYDTSKLASG VPGRFSGSGS GNSYSLTISS VEAEDDATYY CQQWSKHPLT FGAGTKLEIK AAAGSGGSGI IHVKGKHLCP SPLFPGPSKP FWVLVVVGGV LACYSLLVTV AFIIFWVRSK RSLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |
| 304 | GM-CSF_SS1_spCD28(trun) | MWLQSLLLLG TVACSISQVQ LQQSGPELEK PGASVKLSCK ASGYSFTGYT MNWVKQSHGK SLEWIGLITP YNGASSYNQK FRGKATLTVD KSSSTAYMDL LSLTSEDSAV YFCARGGYDG RGFDYWGQGT TVTVSSGGGG SGGGGSGGGG SDIELTQSPA IMSASPGEKV TMTCSASSSV SYMHWYQQKS GTSPKRWIYD |

TABLE 7-continued

Amino Acid Sequences

| ID No | Component | Sequence |
|---|---|---|
| | _CD28_CD4 0 | TSKLASGVPG RFSGSGSGNS YSLTISSVEA EDDATYYCQQ WSKHPLTFGA GTKLEIKAAA GSGGSGIIHV KGKHLCPSPL FPGPSKPFWV LVVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 305 | hIgGk-VIII_SS1_spCD28 (trun)_CD28_CD4 0 | MEAPAQLLFL LLLWLPDTTR QVQLQQSGPE LEKPGASVKL SCKASGYSFT GYTMNWVKQS HGKSLEWIGL ITPYNGASSY NQKFRGKATL TVDKSSSTAY MDLLSLTSED SAVYFCARGG YDGRGFDYWG QGTTVTVSSG GGGSGGGGSG GGGSDIELTQ SPAIMSASPG EKVTMTCSAS SSVSYMHWYQ QKSGTSPKRW IYDTSKLASG VPGRFSGSGS GNSYSLTISS VEAEDDATYY CQQWSKHPLT FGAGTKLEIK AAAGSGGSGI IHVKGKHLCP SPLFPGPSKP FWVLVVVGGV LACYSLLVTV AFIIFWVRSK RSRLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |
| 306 | OSM_M5_spCD28 (trun)_CD28_CD4 0 CTP249 | MGVLLTQRTL LSLVLALLFP SMASMQVQLV QSGAEVEKPG ASVKVSCKAS GYTFTDYYMH WVRQAPGQGL EWMGWINPNS GGTNYAQKFQ GRVTMTRDTS ISTAYMELSR LRSDDTAVYY CASGWDFDYW GQGTLVTVSS GGGGSGGGGS GGGGSDIVMT QSPSSLSASV GDRVTITCRA SQSIRYYLSW YQQKPGKAPK LLIYTASILQ NGVPSRFSGS GSGTDFTLTI SSLQPEDFAT YYCLQTYTTP DFGPGTKVEI KAAAGSGGGS IIHVKGKHLC PSPLFPGPSK PFWVLVVVGG VLACYSLLVT VAFIIFWVRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 307 | CD8a_M5_spCD28 (trun)_CD28_CD4 0 | MALPVTALLL PLALLLHAAR PQVQLVQSGA EVEKPGASVK VSCKASGYTF TDYYMHWVRQ APGQGLEWMG WINPNSGGTN YAQKFQGRVT MTRDTSISTA YMELSRLRSD DTAVYYCASG WDFDYWGQGT LVTVSSGGGG SGGGGSGGGG SDIVMTQSPS SLSASVGDRV TITCRASQSI RYYLSWYQQK PGKAPKLLIY TASILQNGVP SRFSGSGSGT DFTLTISSLQ PEDFATYYCL QTYTTPDFGP GTKVEIKAAA GSGGSGIIHV KGKHLCPSPL FPGPSKPFWV LVVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 308 | CD2_M5_spCD28 (trun)_CD28_CD4 0 | MSFPCKFVAS FLLIFNVSSK GAVSQVQLVQ SGAEVEKPGA SVKVSCKASG YTFTDYYMHW VRQAPGQGLE WMGWINPNSG GTNYAQKFQG RVTMTRDTSI STAYMELSRL RSDDTAVYYC ASGWDFDYWG QGTLVTVSSG GGGSGGGGSG GGGSDIVMTQ SPSSLSASVG DRVTITCRAS QSIRYYLSWY QQKPGKAPKL LIYTASILQN GVPSRFSGSG SGTDFTLTIS SLQPEDFATY YCLQTYTTPD FGPGTKVEIK AAAGSGGSGI IHVKGKHLCP SPLFPGPSKP FWVLVVVGGV LACYSLLVTV AFIIFWVRSK RSRLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |
| 309 | IL2_M5_spCD28 (trun)_CD28_CD4 0 | MYRMQLLSCI ALSLALVTNS QVQLVQSGAE VEKPGASVKV SCKASGYTFT DYYMHWVRQA PGQGLEWMGW INPNSGGTNY AQKFQGRVTM TRDTSISTAY MELSRLRSDD TAVYYCASGW DFDYWGQGTL VTVSSGGGGS GGGGSGGGGS DIVMTQSPSS LSASVGDRVT ITCRASQSIR YYLSWYQQKP GKAPKLLIYT ASILQNGVPS RFSGSGSGTD FTLTISSLQP EDFATYYCLQ TYTTPDFGPG TKVEIKAAAG SGGSGIIHVK GKHLCPSPLF PGPSKPFWVL VVVGGVLACY SLLVTVAFII FWVRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 310 | GM-CSF_M5_spCD28 (trun)_CD28_CD4 0 | MWLQSLLLLG TVACSISQVQ LVQSGAEVEK PGASVKVSCK ASGYTFTDYY MHWVRQAPGQ GLEWMGWINP NSGGTNYAQK FQGRVTMTRD TSISTAYMEL SRLRSDDTAV YYCASGWDFD YWGQGTLVTV SSGGGGSGGG GSGGGGSDIV MTQSPSSLSA SVGDRVTITC RASQSIRYYL SWYQQKPGKA PKLLIYTASI LQNGVPSRFS GSGSGTDFTL TISSLQPEDF ATYYCLQTYT TPDFGPGTKV EIKAAAGSGG SGIIHVKGKH LCPSPLFPGP SKPFWVLVVV GGVLACYSLL VTVAFIIFWV RSKRSRLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |
| 311 | hIgGk-VIII_M5_spCD28 (trun)_CD28_CD4 0 | MEAPAQLLFL LLLWLPDTTR QVQLVQSGAE VEKPGASVKV SCKASGYTFT DYYMHWVRQA PGQGLEWMGW INPNSGGTNY AQKFQGRVTM TRDTSISTAY MELSRLRSDD TAVYYCASGW DFDYWGQGTL VTVSSGGGGS GGGGSGGGGS DIVMTQSPSS LSASVGDRVT ITCRASQSIR YYLSWYQQKP GKAPKLLIYT ASILQNGVPS RFSGSGSGTD FTLTISSLQP EDFATYYCLQ TYTTPDFGPG TKVEIKAAAG SGGSGIIHVK GKHLCPSPLF PGPSKPFWVL VVVGGVLACY SLLVTVAFII FWVRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |

TABLE 7-continued

Amino Acid Sequences

| ID No | Component | Sequence |
|---|---|---|
| 312 | OSM_HN1_spCD28(trun)_CD28_CD4 0 CTP250 | MGVLLTQRTL LSLVLALLFP SMASMQVQLV QSGAEVKRPG ASVQVSCRAS GYSINTYYMQ WVRQAPGAGL EWMGVINPSG VTSYAQKFQG RVTLTNDTST NTVYMQLNSL TSADTAVYYC ARWALWGDFG MDVWGKGTLV TVSSGGGGSG GGGSGGGGSD IQMTQSPSTL SASIGDRVTI TCRASEGIYH WLAWYQQKPG KAPKLLIYKA SSLASGAPSR FSGSGSGTDF TLTISSLQPD DFATYYCQQY SNYPLTFGGG TKLEIKAAAG SGGSGIIHVK GKHLCPSPLF PGPSKPFWVL VVVGGVLACY SLLVTVAFII FWVRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 313 | CD8a_HN1_spCD28(trun)_CD28_CD4 0 | MALPVTALLL PLALLLHAAR PQVQLVQSGA EVKRPGASVQ VSCRASGYSI NTYYMQWVRQ APGAGLEWMG VINPSGVTSY AQKFQGRVTL TNDTSTNTVY MQLNSLTSAD TAVYYCARWA LWGDFGMDVW GKGTLVTVSS GGGGSGGGGS GGGGSDIQMT QSPSTLSASI GDRVTITCRA SEGIYHWLAW YQQKPGKAPK LLIYKASSLA SGAPSRFSGS GSGTDFTLTI SSLQPDDFAT YYCQQYSNYP LTFGGGTKLE IKAAGSGGS GIIHVKGKHL CPSPLFPGPS KPFWVLVVVG GVLACYSLLV TVAFIIFWVR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 314 | CD2_HN1_spCD28(trun)_CD28_CD4 0 | MSFPCKFVAS FLLIFNVSSK GAVSQVQLVQ SGAEVKRPGA SVQVSCRASG YSINTYYMQW VRQAPGAGLE WMGVINPSGV TSYAQKFQGR VTLTNDTSTN TVYMQLNSLT SADTAVYYGA RWALWGDFGM DVWGKGTLVT VSSGGGGSGG GGSGGGGSDI QMTQSPSTLS ASIGDRVTIT CRASEGIYHW LAWYQQKPGK APKLLIYKAS SLASGAPSRF SGSGSGTDFT LTISSLQPDD FATYYCQQYS NYPLTFGGGT KLEIKAAAGS GGSGIIHVKG KHLCPSPLFP GPSKPFWVLV VVGGVLACYS LLVTVAFIIF WVRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 315 | IL2_HN1_spCD28(trun)_CD28_CD4 0 | MYRMQLLSCI ALSLALVTNS QVQLVQSGAE VKRPGASVQV SCRASGYSIN TYYMQWVRQA PGAGLEWMGV INPSGVTSYA QKFQGRVTLT NDTSTNTVYM QLNSLTSADT AVYYCARWAL WGDFGMDVWG KGTLVTVSSG GGGSGGGGSG GGGSDIQMTQ SPSTLSASIG DRVTITCRAS EGIYHWLAWY QQKPGKAPKL LIYKASSLAS GAPSRFSGSG SGTDFTLTIS SLQPDDFATY YCQQYSNYPL TFGGGTKLEI KAAAGSGGS IIHVKGKHLC PSPLFPGPSK PFWVLVVVGG VLACYSLLVT VAFIIFWVRS KRSRLLHSDY MNMTPRRPGP TRKHYQPYAP PRDFAAYRSK VAKKPTNKA PHPKQEPQEI NFPDDLPGSN TAAPVQETLH GCQPVTQEDG KESRISVQER Q |
| 316 | GM-CSF_HN1_spCD28(trun)_CD28_CD4 0 | MWLQSLLLLG TVACSISQVQ LVQSGAEVKR PGASVQVSCR ASGYSINTYY MQWVRQAPGA GLEWMGVINP SGVTSYAQKF QGRVTLTNDT STNTVYMQLN SLTSADTAVY YCARWALWGD FGMDVWGKGT LVTVSSGGGG SGGGGSGGGG SDIQMTQSPS TLSASIGDRV TITCRASEGI YHWLAWYQQK PGKAPKLLIY KASSLASGAP SRFSGSGSGT DFTLTISSLQ PDDFATYYCQ QYSNYPLTFG GGTKLEIKAA AGSGGSGIIH VKGKHLCPSP LFPGPSKPFW VLVVVGGVLA CYSLLVTVAF IIFWVRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 317 | hIgGk-VIII_HN1_spCD28(trun)_CD28_CD4 0 | MEAPAQLLFL LLLWLPDTTR QVQLVQSGAE VKRPGASVQV SCRASGYSIN TYYMQWVRQA PGAGLEWMGV INPSGVTSYA QKFQGRVTLT NDTSTNTVYM QLNSLTSADT AVYYCARWAL WGDFGMDVWG KGTLVTVSSG GGGSGGGGSG GGGSDIQMTQ SPSTLSASIG DRVTITCRAS EGIYHWLAWY QQKPGKAPKL LIYKASSLAS GAPSRFSGSG SGTDFTLTIS SLQPDDFATY YCQQYSNYPL TFGGGTKLEI KAAAGSGGS IIHVKGKHLC PSPLFPGPSK PFWVLVVVGG VLACYSLLVT VAFIIFWVRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 318 | OSM_M912_spCD28(trun)_CD28_CD4 0 CTP251 | MGVLLTQRTL LSLVLALLFP SMASMQVQLQ ESGPGLVKPS ETLSLTCTVS GGSVSSGSYY WSWIRQPPGK GLEWIGYIYY SGSTNYNPSL KSRVTISVDT SKNQFSLKLS SVTAADTAVY YCAREGKNGA FDIWGQGTMV TVSSGGGGSG GGGSGGGGSD IQMTQSPSSL SASVGDRVTI TCRASQSISS YLNWYQQKPG KAPKLLIYAA SSLQSGVPSG FSGSGSGTDF TLTISSLQPE DFATYYCQQS YSTPLTFGGG TKVEIKAAAG SGGSGIIHVK GKHLCPSPLF PGPSKPFWVL VVGGVLACY SLLVTVAFII FWVRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |

TABLE 7-continued

Amino Acid Sequences

| ID No | Component | Sequence |
|---|---|---|
| 319 | CD8a_M912_spCD28(trun)_CD28_CD4 0 | MALPVTALLL PLALLLHAAR PQVQLQESGP GLVKPSETLS LTCTVSGGSV SSGSYYWSWI RQPPGKGLEW IGYIYYSGST NYNPSLKSRV TISVDTSKNQ FSLKLSSVTA ADTAVYYCAR EGKNGAFDIW GQGTMVTVSS GGGGSGGGGS GGGGSDIQMT QSPSSLSASV GDRVTITCRA SQSISSYLNW YQQKPGKAPK LLIYAASSLQ SGVPSGFSGS GSGTDFTLTI SSLQPEDFAT YYCQQSYSTP LTFGGGTKVE IKAAAGSGGS GIIHVKGKHL CPSPLFPGPS KPFWVLVVVG GVLACYSLLV TVAFIIFWVR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 320 | CD2_M912_spCD28(trun)_CD28_CD4 0 | MSFPCKFVAS FLLIFNVSSK GAVSQVQLQE SGPGLVKPSE TLSLTCTVSG GSVSSGSYYW SWIRQPPGKG LEWIGYIYYS GSTNYNPSLK SRVTISDTS KNQFSLKLSS VTAADTAVYY CAREGKNGAF DIWGQGTMVT VSSGGGGSGG GGSGGGGSDI QMTQSPSSLS ASVGDRVTIT CRASQSISSY LNWYQQKPGK APKLLIYAAS SLQSGVPSGF SGSGSGTDFT LTISSLQPED FATYYCQQSY STPLTFGGGT KVEIKAAAGS GGSGIIHVKG KHLCPSPLFP GPSKPFWVLV VVGGVLACYS LLVTVAFIIF WVRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 321 | IL2_M912_spCD28(trun)_CD28_CD4 0 | MYRMQLLSCI ALSLALVTNS QVQLQESGPG LVKPSETLSL TCTVSGGSVS SGSYYWSWIR QPPGKGLEWI GYIYYSGSTN YNPSLKSRVT ISVDTSKNQF SLKLSSVTAA DTAVYYCARE GKNGAFDIWG QGTMVTVSSG GGGSGGGGSG GGGSDIQMTQ SPSSLSASVG DRVTITCRAS QSISSYLNWY QQKPGKAPKL LIYAASSLQS GVPSGFSGSG SGTDFTLTIS SLQPEDFATY YCQQSYSTPL TFGGGTKVEI KAAAGSGGGS IIHVKGKHLC PSPLFPGPSK PFWVLVVVGG VLACYSLLVT VAFIIFWVRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 322 | GM-CSF_M912_spCD28(trun)_CD28_CD4 0 | MWLQSLLLLG TVACSISQVQ LQESGPGLVK PSETLSLTCT VSGGSVSSGS YYWSWIRQPP GKGLEWIGYI YYSGSTNYNP SLKSRVTISV DTSKNQFSLK LSSVTAADTA VYYCAREGKN GAFDIWGQGT MVTVSSGGGG SGGGGSGGGG SDIQMTQSPS SLSASVGDRV TITCRASQSI SSYLNWYQQK PGKAPKLLIY AASSLQSGVP SGFSGSGSGT DFTLTISSLQ PEDFATYYCQ QSYSTPLTFG GGTKVEIKAA AGSGGSGIIH VKGKHLCPSP LFPGPSKPFW VLVVVGGVLA CYSLLVTVAF IIFWVRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 323 | hIgGk-VIII_M912_spCD28(trun)_CD28_CD4 0 | MEAPAQLLFL LLLWLPDTTR QVQLQESGPG LVKPSETLSL TCTVSGGSVS SGSYYWSWIR QPPGKGLEWI GYIYYSGSTN YNPSLKSRVT ISVDTSKNQF SLKLSSVTAA DTAVYYCARE GKNGAFDIWG QGTMVTVSSG GGGSGGGGSG GGGSDIQMTQ SPSSLSASVG DRVTITCRAS QSISSYLNWY QQKPGKAPKL LIYAASSLQS GVPSGFSGSG SGTDFTLTIS SLQPEDFATY YCQQSYSTPL TFGGGTKVEI KAAAGSGGGS IIHVKGKHLC PSPLFPGPSK PFWVLVVVGG VLACYSLLVT VAFIIFWVRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 324 | OSM_HuYP218_spCD28(trun)_CD28_CD4 0 CTP252 | MGVLLTQRTL LSLVLALLFP SMASMEVQLV ESGGGLVQPG GSLRLSCAAS GFDLGFYFYA CWVRQAPGKG LEWVSCIYTA GSGSTYYASW AKGRFTISRD NSKNTLYLQM NSLRAEDTAV YYCARSTANT RSTYYLNLWG QGTLVTVSSG GGGSGGGGSG GGGSDIQMTQ SPSSLSASVG DRVTITCQAS QRISSYLSWY QQKPGKVPKL LIYGASTLAS GVPSRFSGSG SGTDFTLTIS SLQPEDVATY YCQSYAYFDS NNWHAFGGGT KVEIAAAGSG GSGIIHVKGK HLCPSPLFPG PSKPFWVLVV VGGVLACYSL LVTVAFIIFW VRSKRSRLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |
| 325 | CD8a_HuYP218_spCD28(trun)_CD28_CD4 0 | MALPVTALLL PLALLLHAAR PEVQLVESGG GLVQPGGSLR LSCAASGFDL GFYFYACWVR QAPGKGLEWV SCIYTAGSGS TYYASWAKGR FTISRDNSKN TLYLQMNSLR AEDTAVYYCA RSTANTRSTY YLNLWGQGTL VTVSSGGGGS GGGGSGGGGS DIQMTQSPSS LSASVGDRVT ITCQASQRIS SYLSWYQQKP GKVPKLLIYG ASTLASGVPS RFSGSGSGTD FTLTISSLQP EDVATYYCQS YAYFDSNNWH AFGGGTKVEI AAAGSGGSGI IHVKGKHLCP SPLFPGPSKP FWVLVVVGGV LACYSLLVTV AFIIFWVRSK RSRLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |
| 326 | CD2_HuYP218_spCD28(trun) | MSFPCKFVAS FLLIFNVSSK GAVSEVQLVE SGGGLVQPGG SLRLSCAASG FDLGFYFYAC WVRQAPGKGL EWVSCIYTAG SGSTYYASWA KGRFTISRDN SKNTLYLQMN SLRAEDTAVY YCARSTANTR STYYLNLWGQ GTLVTVSSGG GGSGGGGSGG GGSDIQMTQS PSSLSASVGD RVTITCQASQ RISSYLSWYQ |

TABLE 7-continued

Amino Acid Sequences

| ID No | Component | Sequence |
|---|---|---|
| | _CD28_CD4 0 | QKPGKVPKLL IYGASTLASG VPSRFSGSGS GTDFTLTISS LQPEDVATYY CQSYAYFDSN NWHAFGGGTK VEIAAAGSGG SGIIHVKGKH LCPSPLFPGP SKPFWVLVVV GGVLACYSLL VTVAFIIFWV RSKRSLLHS DYMNMTPRRP GPTRKHYQPY APPRDFAAYR SKKVAKKPTN KAPHPKQEPQ EINFPDDLPG SNTAAPVQET LHGCQPVTQE DGKESRISVQ ERQ |
| 327 | IL2_HuYP2 18 _spCD28 (trun) _CD28_CD4 0 | MYRMQLLSCI ALSLALVTNS EVQLVESGGG LVQPGGSLRL SCAASGFDLG FYFYACWVRQ APGKGLEWVS GIYTAGSGST YYASWAKGRF TISRDNSKNT LYLQMNSLRA EDTAVYYCAR STANTRSTYY LNLWGQGTLV TVSSGGGGSG GGGSGGGGSD IQMTQSPSSL SASVGDRVTI TCQASQRISS YLSWYQQKPG KVPKLLIYGA STLASGVPSR FSGSGSGTDF TLTISSLQPE DVATYYCQSY AYFDSNNWHA FGGGTKVEIA AAGSGSGII HVKGKHLCPS PLFPGPSKPF WVLVVVGGVL ACYSLLVTVA FIIFWVRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |
| 328 | GM-CSF_HuYP2 18 _spCD28 (trun) _CD28_CD4 0 | MWLQSLLLLG TVACSISEVQ LVESGGGLVQ PGGSLRLSCA ASGFDLGFYF YACWVRQAPG KGLEWVSCIY TAGGSTYYA SWAKGRFTIS RDNSKNTLYL QMNSLRAEDT AVYYCARSTA NTRSTYYLNL WGQGTLVTVS SGGGGSGGGG SGGGGSDIQM TQSPSSLSAS VGDRVTITCQ ASQRISSYLS WYQQKPGKVP KLLIYGASTL ASGVPSRFSG SGSGTDFTLT ISSLQPEDVA TYYCQSYAYF DSNNWHAFGG GTKVEIAAAG SGGSGIIHVK GKHLCPSPLF PGPSKPFWVL VVGGVLACY SLLVTVAFII FWVRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 329 | hIgGk-VIII _HuYP218 _spCD28 (trun) _CD28_CD4 0 | MEAPAQLLFL LLLWLPDTTR EVQLVESGGG LVQPGGSLRL SCAASGFDLG FYFYACWVRQ APGKGLEWVS GIYTAGSGST YYASWAKGRF TISRDNSKNT LYLQMNSLRA EDTAVYYCAR STANTRSTYY LNLWGQGTLV TVSSGGGGSG GGGSGGGGSD IQMTQSPSSL SASVGDRVTI TCQASQRISS YLSWYQQKPG KVPKLLIYGA STLASGVPSR FSGSGSGTDF TLTISSLQPE DVATYYCQSY AYFDSNNWHA FGGGTKVEIA AAGSGGSGII HVKGKHLCPS PLFPGPSKPF WVLVVVGGVL ACYSLLVTVA FIIFWVRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |
| 330 | OSM_P4 _spCD28 (trun) _CD28_CD4 0 CTP253 | MGVLLTQRTL LSLVLALLFP SMASMQVQLQ QSGPGLVTPS QTLSLTCAIS GDSVSSNSAT WNWIRQSPSR GLEWLGRTYY RSKWYNDYAV SVKSRMSINP DTSKNQFSLQ LNSVTPEDTA VYYCARGMMT YYYGMDVWGQ GTTVTVSSGG GGSGGGGSGG GGSQPVLTQS SSLSASPGAS ASLTCTLRSG INVGPYRIYW YQQKPGSPPQ YLLNYKSDSD KQQGSGVPSR FSGSKDASAN AGVLLISGLR SEDEADYYCM IWHSSAAVFG GGTQLTVLSA AAGSGGSGII HVKGKHLCPS PLFPGPSKPF WVLVVVGGVL ACYSLLVTVA FIIFWVRSKR SRLLHSDYMN MTPRRPGPTR KHYQPYAPPR DFAAYRSKKV AKKPTNKAPH PKQEPQEINF PDDLPGSNTA APVQETLHGC QPVTQEDGKE SRISVQERQ |
| 331 | CD8a_P4 _spCD28 (trun) _CD28_CD4 0 | MALPVTALLL PLALLLHAAR PQVQLQQSGP GLVTPSQTLS LTCAISGDSV SSNSATWNWI RQSPSRGLEW LGRTYYRSKW YNDYAVSVKS RMSINPDTSK NQFSLQLNSV TPEDTAVYYC ARGMMTYYYG MDVWGQGTTV TVSSGGGGSG GGGSGGGGSQ PVLTQSSSLS ASPGASASLT CTLRSGINVG PYRIYWYQQK PGSPPQYLLN YKSDSDKQQG SGVPSRFSGS KDASANAGVL LISGLRSEDE ADYYCMIWHS SAAVFGGGTQ LTVLSAAAGS GGSGIIHVKG KHLCPSPLFP GPSKPFWVLV VVGGVLACYS LLVTVAFIIF WVRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 332 | CD2_P4 _spCD28 (trun) _CD28_CD4 0 | MSFPCKFVAS FLLIFNVSSK GAVSQVQLQQ SGPGLVTPSQ TLSLTCAISG DSVSSNSATW NWIRQSPSRG LEWLGRTYYR SKWYNDYAVS VKSRMSINPD TSKNQFSLQL NSVTPEDTAV YYCARGMMTY YYGMDVWGQG TTVTVSSGGG GSGGGGSGGG GSQPVLTQSS SLSASPGASA SLTCTLRSGI NVGPYRIYWY QQKPGSPPQY LLNYKSDSDK QQGSGVPSRF SGSKDASANA GVLLISGLRS EDEADYYCMI WHSSAAVFGG GTQLTVLSAA AGSGGSGIIH VKGKHLCPSP LFPGPSKPFW VLVVGGVLA CYSLLVTVAF IIFWVRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 333 | IL2_P4 _spCD28 (trun) _CD28_CD4 0 | MYRMQLLSCI ALSLALVTNS QVQLQQSGPG LVTPSQTLSL TCAISGDSVS SNSATWNWIR QSPSRGLEWL GRTYYRSKWY NDYAVSVKSR MSINPDTSKN QFSLQLNSVT PEDTAVYYCA RGMMTYYYGM DVWGQGTTVT VSSGGGGSGG GGSGGGGSQP VLTQSSSLSA SPGASASLTC TLRSGINVGP YRIYWYQQKP GSPPQYLLNY KSDSDKQQGS GVPSRFSGSK DASANAGVLL ISGLRSEDEA DYYCMIWHSS AAVFGGGTQL TVLSAAAGSG GSGIIHVKGK HLCPSPLFPG PSKPFWVLVV VGGVLACYSL LVTVAFIIFW VRSKRSRLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |

TABLE 7-continued

Amino Acid Sequences

| ID No | Component | Sequence |
|---|---|---|
| 334 | GM-CSF_P4_spCD28 (trun)_CD28_CD4 0 | MWLQSLLLLG TVACSISQVQ LQQSGPGLVT PSQTLSLTCA ISGDSVSSNS ATWNWIRQSP SRGLEWLGRT YYRSKWYNDY AVSVKSRMSI NPDTSKNQFS LQLNSVTPED TAVYYCARGM MTYYYGMDVW GQGTTVTVSS GGGGSGGGGS GGGGSQPVLT QSSSLSASPG ASASLTCTLR SGINVGPYRI YWYQQKPGSP PQYLLNYKSD SDKQQGSGVP SRFSGSKDAS ANAGVLLISG LRSEDEADYY CMIWHSSAAV FGGGTQLTVL SAAAGSGGSG IIHVKGKHLC PSPLFPGPSK PFWVLVVGG VLACYSLLVT VAFIIFWVRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 335 | hIgGk-VIII_P4_spCD28 (trun)_CD28_CD4 0 | MEAPAQLLFL LLLWLPDTTR QVQLQQSGPG LVTPSQTLSL TCAISGDSVS SNSATWNWIR QSPSRGLEWL GRTYYRSKWY NDYAVSVKSR MSINPDTSKN QFSLQLNSVT PEDTAVYYCA RGMMTYYYGM DVWGQGTTVT VSSGGGGSGG GGSGGGGSQP VLTQSSSLSA SPGASASLTC TLRSGINVGP YRIYWYQQKP GSPPQYLLNY KSDSDKQQGS GVPSRFSGSK DASANAGVLL ISGLRSEDEA DYYCMIWHSS AAVFGGGTQL TVLSAAAGSG GSGIIHVKGK HLCPSPLFPG PSKPFWVLVV VGGVLACYSL LVTVAFIIFW VRSKRSRLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |
| 336 | NTRK1 IC domain | NKCGRRNKFG INRPAVLAPE DGLAMSLHFM TLGGSSLSPT EGKGSGLQGH IIENPQYFSD ACVHHIKRRD IVLKWELGEG AFGKVFLAEC HNLLPEQDKM LVAVKALKEA SESARQDFQR EAELLTMLQH QHIVRFFGVC TEGRPLLMVF EYMRHGDLNR FLRSHGPDAK LLAGGEDVAP GPLGLGQLLA VASQVAAGMV YLAGLHFVHR DLATRNCLVG QGLVVKIGDF GMSRDIYSTD YYRVGGRTML PIRWMPPESI LYRKFTTESD VWSFGVVLWE IFTYGKQPWY QLSNTEAIDC ITQGRELERP RACPPEVYAI MRGCWQREPQ QRHSIKDVHA RLQALAQAPP VYLDVLG |
| 337 | ICOS | MKSGLWYFFL FLCRIKVLTG EINGSANYEM FIFHNGGVQI LCKYPDIVQQ FKMQLLKGGQ ILCDLTKTKG SGNTVSIKSL KPFCHSQLSNN SVSFFLYNLD HSHANYYFCN LSIFDPPPFK VTLTGGYLHI YESQLCCQLK FWLPIGCAAF VVVCILGCIL ICWLTKKKYS SVHDPNGEY MFMRAVNTAK KSRLTDVTL |
| 338 | ICOS IC domain | CWLTKKKYSS SVHDPNGEYM FMRAVNTAKK SRLTDVTL |
| 339 | mouse CD2 | RDNETIWGVL GHGITLNIPN FQMTDDIDEV RWVRRGTLVA EFKRKKPPFL ISETYEVLAN GSLKIKKPMM RNDSGTYNVM VYGTNGMTRL EKDLDVRILE RVSKPMIHWE CPNTTLTCAV LQGTDFELKL YQGETLLNSL PQKNMSYQWT NLNAPFKCEA INPVSKESKM EVVNCPEKGL SFYVTVGVGA GGLLLVLLVA LFIFCICKRR KRNRRRKDEE LEIKASRTST VERGPKPHST PAAAAQNSVA LQAPPPPGHH LQTPGHRPLP PGHRTREHQQ KKRPPPSGTQ IHQQKGPPLP RPRVQPKPPC GSGDGVSLPP PN |
| 340 | mouse CD2 IC domain | KRRKRNRRRK DEELEIKASR TSTVERGPKP HSTPAAAAQN SVALQAPPPP GHHLQTPGHR PLPPGHRTRE HQQKKRPPPS GTQIHQQKGP PLPRPRVQPK PPCGSGDGVS LPPPN |
| 341 | CD137 IC domain | KRGRKKLLYI FKQPFMRPVQ TTQEEDGCSC RFPEEEEGGC EL |
| 342 | DAP10 IC domain | LCARPRRSPA QEDGKVYINM PGRG |
| 343 | CD134 IC domain | ALYLLRRDQR LPPDAHKPPG GGSFRTPIQE EQADAHSTLA KI |
| 344 | hMFE23. TMtCD28.N TRK1 CTP313 | MGVLLTQRTL LSLVLALLFP SMASMQVKLE QSGAEVVKPG ASVKLSCKAS GFNIKDSYMH WLRQGPGQRL EWIGWIDPEN GDTEYAPKFQ GKATFTTDTS ANTAYLGLSS LRPEDTAVYY CNEGTPTGPY YFDYWGQGTL TVSSGGGGS GGGGSGGGGS ENVLTQSPSS MSASVGDRVN IACSASSSVS YMHWFQQKPG KSPKLWIYST SNLASGVPSR FSGSGSGTDY SLTISSMQPE DAATYYCQQR SSYPLTFGGG TKLEIKAAAG SGGGSILVKQ SPMLVAYDNA VNLSCKYSYN LFSREFRASL HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVVGGVLAC YSLLVTVAFI IFWVNKCGRR NKFGINRPAV LAPEDGLAMS LHFMTLGGSS LSPTEGKGSG LQGHIIENPQ YFSDACVHHI KRRDIVLKWE LGEGAFGKVF LAECHNLLPE QDKMLVAVKA LKEASARQ DFQREAELLT MLQHQHIVRF FGVCTEGRPL LMVFEYMRHG DLNRFLRSHG PDAKLLAGGE DVAPGPLGLG QLLAVASQVA AGMVYLAGLH FVHRDLATRN CLVGQGLVVK IGDFGMSRDI YSTDYYRVGG RTMLPIRWMP PESILYRKFT TESDWSFGV VLWEIFTYGK QPWYQLSNTE AIDCITQGRE LERPRACPPE VYAIMRGCWQ REPQQRHSIK DVHARLQALA QAPPVYLDVLG |

TABLE 7-continued

Amino Acid Sequences

| ID No | Component | Sequence |
|---|---|---|
| 345 | hMFE23.TMtCD28.NTRK1.CD40 CTP314 | MGVLLTQRTL LSLVLALLFP SMASMQVKLE QSGAEVVKPG ASVKLSCKAS GFNIKDSYMH WLRQGPGQRL EWIGWIDPEN GDTEYAPKFQ GKATFTTDTS ANTAYLGLSS LRPEDTAVYY CNEGTPTGPY YFDYWGQGTL VTVSSGGGGS GGGGSGGGGS ENVLTQSPSS MSASVGDRVN IACSASSSVS YMHWFQQKPG KSPKLWIYST SNLASGVPSR FSGSGSGTDY SLTISSMQPE DAATYYCQQR SSYPLTFGGG TKLEIKAAAG SGGSGILVKQ SPMLVAYDNA VNLSCKYSYN LFSREFRASL HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVVGGVLAC YSLLVTVAFI IFWVNKCGRR NKFGINRPAV LAPEDGLAMS LHFMTLGGSS LSPTEGKGSG LQGHIIENPQ YFSDACVHHI KRRDIVLKWE LGEGAFGKVF LAECHNLLPE QDKMLVAVKA LKEASESARQ DFQREAELLT MLQHQHIVRF FGVCTEGRPL LMVFEYMRHG DLNRFLRSHG PDAKLLAGGE DVAPGPLGLG QLLAVASQVA AGMVYLAGLH FVHRDLATRN CLVGQGLVVK IGDFGMSRDI YSTDYYRVGG RTMLPIRWMP PESILYRKFT TESDVWSFGV VLWEIFTYGK QPWYQLSNTE AIDCITQGRE LERPRACPPE VYAIMRGCWQ REPQQRHSIK DVHARLQALA QAPPVYLDVL GKKVAKKPTN KAPHPKQEPQ EINFPDDLPG SNTAAPVQET LHGCQPVTQE DGKESRISVQ ERQ |
| 346 | hMFE23.CD28.tICNTRK1 CTP315 | MGVLLTQRTL LSLVLALLFP SMASMQVKLE QSGAEVVKPG ASVKLSCKAS GFNIKDSYMH WLRQGPGQRL EWIGWIDPEN GDTEYAPKFQ GKATFTTDTS ANTAYLGLSS LRPEDTAVYY CNEGTPTGPY YFDYWGQGTL VTVSSGGGGS GGGGSGGGGS ENVLTQSPSS MSASVGDRVN IACSASSSVS YMHWFQQKPG KSPKLWIYST SNLASGVPSR FSGSGSGTDY SLTISSMQPE DAATYYCQQR SSYPLTFGGG TKLEIKAAAG SGGSGILVKQ SPMLVAYDNA VNLSCKYSYN LFSREFRASL HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVVGGVLAC YSLLVTVAFI IFWVRSKRSR LLHSDYMNMT PRRPGPTRKH YQPYAPPRDF AAYRSNKCGR RNKFGINRPA VLAPEDGLAM SLHFMTLGGS SLSPTEGKGS GLQGHIIENP QYFSDACVHH IKRRDIVLKW ELGEGAFGKV FLAECHNLLP EQDKMLVAVK ALKEASESAR QDFQREAELL TMLQHQHIVR FFGVCTEGRP LLMVFEYMRH GDLNRFLRSH GPDAKLLAGG EDVAPGPLGL GQLLAVASQV AAGMVYLAGL HFVHRDLATR NCLVGQGLVV KIGDFGMSRD IYSTDYYRVG RTMLPIRWM PPESILYRKF TTESDVWSFG VVLWEIFTYG KQPWYQLSNT EAIDCITQGR ELERPRACPP EVYAIMRGCW QREPQQRHSI KDVHARLQAL AQAPPVYLDV LG |
| 347 | hMFE23.CD28.tICNTRK1.CD40 CTP316 | MGVLLTQRTL LSLVLALLFP SMASMQVKLE QSGAEVVKPG ASVKLSCKAS GFNIKDSYMH WLRQGPGQRL EWIGWIDPEN GDTEYAPKFQ GKATFTTDTS ANTAYLGLSS LRPEDTAVYY CNEGTPTGPY YFDYWGQGTL VTVSSGGGGS GGGGSGGGGS ENVLTQSPSS MSASVGDRVN IACSASSSVS YMHWFQQKPG KSPKLWIYST SNLASGVPSR FSGSGSGTDY SLTISSMQPE DAATYYCQQR SSYPLTFGGG TKLEIKAAAG SGGSGILVKQ SPMLVAYDNA VNLSCKYSYN LFSREFRASL HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVVGGVLAC YSLLVTVAFI IFWVRSKRSR LLHSDYMNMT PRRPGPTRKH YQPYAPPRDF AAYRSNKCGR RNKFGINRPA VLAPEDGLAM SLHFMTLGGS SLSPTEGKGS GLQGHIIENP QYFSDACVHH IKRRDIVLKW ELGEGAFGKV FLAECHNLLP EQDKMLVAVK ALKEASESAR QDFQREAELL TMLQHQHIVR FFGVCTEGRP LLMVFEYMRH GDLNRFLRSH GPDAKLLAGG EDVAPGPLGL GQLLAVASQV AAGMVYLAGL HFVHRDLATR NCLVGQGLVV KIGDFGMSRD IYSTDYYRVG RTMLPIRWM PPESILYRKF TTESDVWSFG VVLWEIFTYG KQPWYQLSNT EAIDCITQGR ELERPRACPP EVYAIMRGCW QREPQQRHSI KDVHARLQAL AQAPPVYLDV LGKKVAKKPT NKAPHPKQEP QEINFPDDLP GSNTAAPVQE TLHGCQPVTQ EDGKESRISV QERQ |
| 348 | hMFE23.ICOS.CD40 CTP317 | MGVLLTQRTL LSLVLALLFP SMASMQVKLE QSGAEVVKPG ASVKLSCKAS GFNIKDSYMH WLRQGPGQRL EWIGWIDPEN GDTEYAPKFQ GKATFTTDTS ANTAYLGLSS LRPEDTAVYY CNEGTPTGPY YFDYWGQGTL VTVSSGGGGS GGGGSGGGGS ENVLTQSPSS MSASVGDRVN IACSASSSVS YMHWFQQKPG KSPKLWIYST SNLASGVPSR FSGSGSGTDY SLTISSMQPE DAATYYCQQR SSYPLTFGGG TKLEIKAAAG SGGSGGEING SANYEMFIFH NGGVQILCKY PDIVQQFKMQ LLKGGQILCD LTKTKGSGNT VSIKSLKFCH SQLSNNSVSF FLYNLDHSHA NYYFCNLSIF DPPPFKVTLT GGYLHIYESQ LCCQLKFWLP IGCAAFVVVC ILGCILICWL TKKKYSSSVH DPNGEYMFMR AVNTAKKSRL TDVTLKKVAK KPTNKAPHPK QEPQEINFPD DLPGSNTAAP VQETLHGCQP VTQEDGKESR ISVQERQ |
| 349 | hMFE23.CD28.ICOS CTP318 | MGVLLTQRTL LSLVLALLFP SMASMQVKLE QSGAEVVKPG ASVKLSCKAS GFNIKDSYMH WLRQGPGQRL EWIGWIDPEN GDTEYAPKFQ GKATFTTDTS ANTAYLGLSS LRPEDTAVYY CNEGTPTGPY YFDYWGQGTL VTVSSGGGGS GGGGSGGGGS ENVLTQSPSS MSASVGDRVN IACSASSSVS YMHWFQQKPG KSPKLWIYST SNLASGVPSR FSGSGSGTDY SLTISSMQPE DAATYYCQQR SSYPLTFGGG TKLEIKAAAG SGGSGILVKQ SPMLVAYDNA VNLSCKYSYN |

TABLE 7-continued

Amino Acid Sequences

| ID No | Component | Sequence |
|---|---|---|
| | | LFSREFRASL HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVVGGVLAC YSLLVTVAFI IFWVRSKRSR LLHSDYMNMT PRRPGPTRKH YQPYAPPRDF AAYRSCWLTK KKYSSSVHDP NGEYMFMRAV NTAKKSRLTD VTL |
| 350 | hMFE23.CD 28. ICOS.CD40 CTP319 | MGVLLTQRTL LSLVLALLFP SMASMQVKLE QSGAEVVKPG ASVKLSCKAS GFNIKDSYMH WLRQGPGQRL EWIGWIDPEN GDTEYAPKFQ GKATFTTDTS ANTAYLGLSS LRPEDTAVYY CNEGTPTGPY YFDYWGQGTL VTVSSGGGGS GGGGSGGGGS ENVLTQSPSS MSASVGDRVN IACSASSSVS YMHWFQQKPG KSPKLWIYST SNLASGVPSR FSGSGSGTDY SLTISSMQPE DAATYYCQQR SSYPLTFGGG TKLEIKAAAG SGGGSILVKQ SPMLVAYDNA VNLSCKYSYN LFSREFRASL HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVVGGVLAC YSLLVTVAFI IFWVRSKRSR LLHSDYMNMT PRRPGPTRKH YQPYAPPRDF AAYRSCWLTK KKYSSSVHDP NGEYMFMRAV NTAKKSRLTD VTLKKVAKKP TNKAPHPKQE PQEINFPDDL PGSNTAAPVQ ETLHGCQPVT QEDGKESRIS VQERQ |
| 351 | hMFE23.CD 2.CD40 CTP320 | MGVLLTQRTL LSLVLALLFP SMASMQVKLE QSGAEVVKPG ASVKLSCKAS GFNIKDSYMH WLRQGPGQRL EWIGWIDPEN GDTEYAPKFQ GKATFTTDTS ANTAYLGLSS LRPEDTAVYY CNEGTPTGPY YFDYWGQGTL VTVSSGGGGS GGGGSGGGGS ENVLTQSPSS MSASVGDRVN IACSASSSVS YMHWFQQKPG KSPKLWIYST SNLASGVPSR FSGSGSGTDY SLTISSMQPE DAATYYCQQR SSYPLTFGGG TKLEIKAAAG SGGGSRDNET IWGVLGHGIT LNIPNFQMTD DIDEVRWVRR GTLVAEFKRK KPPFLISETY EVLANGSLKI KKPMMRNDSG TYNVMVYGTN GMTRLEKDLD VRILERVSKP MIHWECPNTT LTCAVLQGTD FELKLYQGET LLNSLPQKNM SYQWTNLNAP FKCEAINPVS KESKMEVVNC PEKGLSFYVT VGVGAGGLLL VLLVALFIFC ICKRRKRNRR RKDEELEIKA SRTSTVERGP KPHSTPAAAA QNSVALQAPP PPGHHLQTPG HRPLPPGHRT REHQQKKRPP PSGTQIHQQK GPPLPRPRVQ PKPPCGSGDG VSLPPPNKKV AKKPTNKAPH PKQEPQEINF PDDLPGSNTA APVQETLHGC QPVTQEDGKE SRISVQERQ |
| 352 | hMFE23. CD28.CD2 CTP321 | MGVLLTQRTL LSLVLALLFP SMASMQVKLE QSGAEVVKPG ASVKLSCKAS GFNIKDSYMH WLRQGPGQRL EWIGWIDPEN GDTEYAPKFQ GKATFTTDTS ANTAYLGLSS LRPEDTAVYY CNEGTPTGPY YFDYWGQGTL VTVSSGGGGS GGGGSGGGGS ENVLTQSPSS MSASVGDRVN IACSASSSVS YMHWFQQKPG KSPKLWIYST SNLASGVPSR FSGSGSGTDY SLTISSMQPE DAATYYCQQR SSYPLTFGGG TKLEIKAAAG SGGGSILVKQ SPMLVAYDNA VNLSCKYSYN LFSREFRASL HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVVGGVLAC YSLLVTVAFI IFWVRSKRSR LLHSDYMNMT PRRPGPTRKH YQPYAPPRDF AAYRSKRRKR NRRRKDEELE IKASRTSTVE RGPKPHSTPA AAAQNSVALQ APPPPGHHLQ TPGHRPLPPG HRTREHQQKK RPPPSGTQIH QQKGPPLPRP RVQPKPPCGS GDGVSLPPPN |
| 353 | hMFE23.CD 28. CD40.CD2 CTP322 | MGVLLTQRTL LSLVLALLFP SMASMQVKLE QSGAEVVKPG ASVKLSCKAS GFNIKDSYMH WLRQGPGQRL EWIGWIDPEN GDTEYAPKFQ GKATFTTDTS ANTAYLGLSS LRPEDTAVYY CNEGTPTGPY YFDYWGQGTL VTVSSGGGGS GGGGSGGGGS ENVLTQSPSS MSASVGDRVN IACSASSSVS YMHWFQQKPG KSPKLWIYST SNLASGVPSR FSGSGSGTDY SLTISSMQPE DAATYYCQQR SSYPLTFGGG TKLEIKAAAG SGGGSILVKQ SPMLVAYDNA VNLSCKYSYN LFSREFRASL HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQKRR KRNRRRKDEE LEIKASRTST VERGPKPHST PAAAQNSVA LQAPPPPGHH LQTPGHRPLP PGHRTREHQQ KKRPPPSGTQ IHQQKGPPLP RPRVQPKPPC GSGDGVSLPP PN |
| 354 | hMFE23. CD28.CD13 7 CTP323 | MGVLLTQRTL LSLVLALLFP SMASMQVKLE QSGAEVVKPG ASVKLSCKAS GFNIKDSYMH WLRQGPGQRL EWIGWIDPEN GDTEYAPKFQ GKATFTTDTS ANTAYLGLSS LRPEDTAVYY CNEGTPTGPY YFDYWGQGTL VTVSSGGGGS GGGGSGGGGS ENVLTQSPSS MSASVGDRVN IACSASSSVS YMHWFQQKPG KSPKLWIYST SNLASGVPSR FSGSGSGTDY SLTISSMQPE DAATYYCQQR SSYPLTFGGG TKLEIKAAAG SGGGSILVKQ SPMLVAYDNA VNLSCKYSYN LFSREFRASL HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVVGGVLAC YSLLVTVAFI IFWVRSKRSR LLHSDYMNMT PRRPGPTRKH YQPYAPPRDF AAYRSKRGRK KLLYIFKQPF MRPVQTTQEE DGCSCRFPEE EEGGCEL |

TABLE 7-continued

Amino Acid Sequences

| ID No | Component | Sequence |
|---|---|---|
| 355 | hMFE23.CD 28. CD40.CD13 7 CTP324 | MGVLLTQRTL LSLVLALLFP SMASMQVKLE QSGAEVVKPG ASVKLSCKAS GFNIKDSYMH WLRQGPGQRL EWIGWIDPEN GDTEYAPKFQ GKATFTTDTS ANTAYLGLSS LRPEDTAVYY CNEGTPTGPY YFDYWGQGTL VTVSSGGGGS GGGGSGGGGS ENVLTQSPSS MSASVGDRVN IACSASSSVS YMHWFQQKPG KSPKLWIYST SNLASGVPSR FSGSGSGTDY SLTISSMQPE DAATYYCQQR SSYPLTFGGG TKLEIKAAAG SGGGILVKQ SPMLVAYDNA VNLSCKYSYN LFSREFRASL HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQKRG RKKLLYIFKQ PFMRPVQTTQ EEDGCSCRFP EEEEGGCEL |
| 356 | hMFE23.CD 28. DAP10 CTP325 | MGVLLTQRTL LSLVLALLFP SMASMQVKLE QSGAEVVKPG ASVKLSCKAS GFNIKDSYMH WLRQGPGQRL EWIGWIDPEN GDTEYAPKFQ GKATFTTDTS ANTAYLGLSS LRPEDTAVYY CNEGTPTGPY YFDYWGQGTL VTVSSGGGGS GGGGSGGGGS ENVLTQSPSS MSASVGDRVN IACSASSSVS YMHWFQQKPG KSPKLWIYST SNLASGVPSR FSGSGSGTDY SLTISSMQPE DAATYYCQQR SSYPLTFGGG TKLEIKAAAG SGGGILVKQ SPMLVAYDNA VNLSCKYSYN LFSREFRASL HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVVGGVLAC YSLLVTVAFI IFWVRSKRSR LLHSDYMNMT PRRPGPTRKH YQPYAPPRDF AAYRSLCARP RRSPAQEDGK VYINMPGRG |
| 357 | hMFE23.CD 28. CD40.DAP1 0 CTP326 | MGVLLTQRTL LSLVLALLFP SMASMQVKLE QSGAEVVKPG ASVKLSCKAS GFNIKDSYMH WLRQGPGQRL EWIGWIDPEN GDTEYAPKFQ GKATFTTDTS ANTAYLGLSS LRPEDTAVYY CNEGTPTGPY YFDYWGQGTL VTVSSGGGGS GGGGSGGGGS ENVLTQSPSS MSASVGDRVN IACSASSSVS YMHWFQQKPG KSPKLWIYST SNLASGVPSR FSGSGSGTDY SLTISSMQPE DAATYYCQQR SSYPLTFGGG TKLEIKAAAG SGGGILVKQ SPMLVAYDNA VNLSCKYSYN LFSREFRASL HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQLCA RPRRSPAQED GKVYINMPGR G |
| 358 | hMFE23.CD 28. CD134 CTP327 | MGVLLTQRTL LSLVLALLFP SMASMQVKLE QSGAEVVKPG ASVKLSCKAS GFNIKDSYMH WLRQGPGQRL EWIGWIDPEN GDTEYAPKFQ GKATFTTDTS ANTAYLGLSS LRPEDTAVYY CNEGTPTGPY YFDYWGQGTL VTVSSGGGGS GGGGSGGGGS ENVLTQSPSS MSASVGDRVN IACSASSSVS YMHWFQQKPG KSPKLWIYST SNLASGVPSR FSGSGSGTDY SLTISSMQPE DAATYYCQQR SSYPLTFGGG TKLEIKAAAG SGGGILVKQ SPMLVAYDNA VNLSCKYSYN LFSREFRASL HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVVGGVLAC YSLLVTVAFI IFWVRSKRSR LLHSDYMNMT PRRPGPTRKH YQPYAPPRDF AAYRSALYLL RRDQRLPPDA HKPPGGGSFR TPIQEEQADA HSTLAKI |
| 359 | hMFE23.CD 28. CD40.CD13 4 CTP328 | MGVLLTQRTL LSLVLALLFP SMASMQVKLE QSGAEVVKPG ASVKLSCKAS GFNIKDSYMH WLRQGPGQRL EWIGWIDPEN GDTEYAPKFQ GKATFTTDTS ANTAYLGLSS LRPEDTAVYY CNEGTPTGPY YFDYWGQGTL VTVSSGGGGS GGGGSGGGGS ENVLTQSPSS MSASVGDRVN IACSASSSVS YMHWFQQKPG KSPKLWIYST SNLASGVPSR FSGSGSGTDY SLTISSMQPE DAATYYCQQR SSYPLTFGGG TKLEIKAAAG SGGGILVKQ SPMLVAYDNA VNLSCKYSYN LFSREFRASL HKGLDSAVEV CVVYGNYSQQ LQVYSKTGFN CDGKLGNESV TFYLQNLYVN QTDIYFCKIE VMYPPPYLDN EKSNGTIIHV KGKHLCPSPL FPGPSKPFWV LVVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQALY LLRRDQRLPP DAHKPPGGGS FRTPIQEEQA DAHSTLAKI |
| 360 | PD1_PD1 _sCD28TM _CD28_CD4 0 (monomeric) CTP189 | MQIPQAPWPV VWAVLQLGWR PGWFLDSPDR PWNPPTFSPA LLVVTEGDNA TFTCSFSNTS ESFVLNWYRM SPSNQTDKLA APFEDRSQPG QDCRFRVTQL PNGRDFHMSV VRARRNDSGT YLCGAISLAP KAQIKESLRA ELRVTERRAE VPTAHPSPSP RPAGQFWVLV VVGGVLACYS LLVTVAFIIF WVRSKRSRLL HSDYMNMTPR RPGPTRKHYQ PYAPPRDFAA YRSKKVAKKP TNKAPHPKQE PQEINFPDDL PGSNTAAPVQ ETLHGCQPVT QEDGKESRIS VQERQ |
| 361 | OSM_MFE23 _spCD28 _CD28_CD4 0 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG |

TABLE 7-continued

Amino Acid Sequences

| ID No | Component | Sequence |
|---|---|---|
| | (SVQE-AVQA) CTP195 | TSPKLWIYST SNLASGVPAR FSGSGSGTSY SLTISRMEAE DAATYYCQQR SSYPLTFGAG TKLELKRAAA GSGGSGILVK QSPMLVAYDN AVNLSCKYSY NLFSREFRAS LHKGLDSAVE VCVVYGNYSQ QLQVYSKTGF NCDGKLGNES VTFYLQNLYV NQTDIYFCKI EVMYPPPYLD NEKSNGTIIH VKGKHLCPSP LFPGPSKPFW VLVVVGGVLA CYSLLVTVAF IIFWVRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RIAVQARQ |
| 362 | OSM_MFE23 _spCD28 _CD28_CD40 (PVQET-AVAEA) CTP196 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGSGILVK QSPMLVAYDN AVNLSCKYSY NLFSREFRAS LHKGLDSAVE VCVVYGNYSQ QLQVYSKTGF NCDGKLGNES VTFYLQNLYV NQTDIYFCKI EVMYPPPYLD NEKSNGTIIH VKGKHLCPSP LFPGPSKPFW VLVVVGGVLA CYSLLVTVAF IIFWVRSKRS RLLHSDYMNM TPRRPGPTRK HYQPYAPPRD FAAYRSKKVA KKPTNKAPHP KQEPQEINFP DDLPGSNTAA AVAEALHGCQ PVTQEDGKES RISVQERQ |
| 363 | OSM_MFE23 _spCD28 _CD28_CD40 (PQEINF-AQAINF) CTP197 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGSGILVK QSPMLVAYDN AVNLSCKYSY NLFSREFRAS LHKGLDSAVE VCVVYGNYSQ QLQVYSKTGF NCDGKLGNES VTFYLQNLYV NQTDIYFCKI EVMYPPPYLD NEKSNGTIIH VKGKHLCPSP LFPGPSKPFW VLVVVGGVLA CYSLLVTVAF IIFWVRSKRS RLLHSDYMNM TPRRPGPTRK HYQPYAPPRD FAAYRSKKVA KKPTNKAPHP KQEAQAINFP DDLPGSNTAA PVQETLHGCQ PVTQEDGKES RISVQERQ |
| 364 | OSM_MFE23 _spCD28 _CD28_CD40 (P227A) CTP198 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGSGILVK QSPMLVAYDN AVNLSCKYSY NLFSREFRAS LHKGLDSAVE VCVVYGNYSQ QLQVYSKTGF NCDGKLGNES VTFYLQNLYV NQTDIYFCKI EVMYPPPYLD NEKSNGTIIH VKGKHLCPSP LFPGPSKPFW VLVVVGGVLA CYSLLVTVAF IIFWVRSKRS RLLHSDYMNM TPRRPGPTRK HYQPYAPPRD FAAYRSKKVA KKPTNKAAHP KQEPQEINFP DDLPGSNTAA PVQETLHGCQ PVTQEDGKES RISVQERQ |
| 365 | OSM_MFE23 _spCD28 _CD28 _CD40 (Q263A) CTP199 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGSGILVK QSPMLVAYDN AVNLSCKYSY NLFSREFRAS LHKGLDSAVE VCVVYGNYSQ QLQVYSKTGF NCDGKLGNES VTFYLQNLYV NQTDIYFCKI EVMYPPPYLD NEKSNGTIIH VKGKHLCPSP LFPGPSKPFW VLVVVGGVLA CYSLLVTVAF IIFWVRSKRS RLLHSDYMNM TPRRPGPTRK HYQPYAPPRD FAAYRSKKVA KKPTNKAPHP KQEPQEINFP DDLPGSNTAA PVQETLHGCQ PVTAEDGKES RISVQERQ |
| 366 | OSM_MFE23 _spCD28 _CD28 _CD40_CD40_CD40 CTP200 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGSGILVK QSPMLVAYDN AVNLSCKYSY NLFSREFRAS LHKGLDSAVE VCVVYGNYSQ QLQVYSKTGF NCDGKLGNES VTFYLQNLYV NQTDIYFCKI EVMYPPPYLD NEKSNGTIIH VKGKHLCPSP LFPGPSKPFW VLVVVGGVLA CYSLLVTVAF IIFWVRSKRS RLLHSDYMNM TPRRPGPTRK HYQPYAPPRD FAAYRSKKVA KKPTNKAPHP KQEPQEINFP DDLPGSNTAA PVQETLHGCQ PVTAEDGKES RISVQERQKK VAKKPTNKAP HPKQEPQEIN FPDDLPGSNT AAPVQETLHG CQPVTAEDGK ESRISVQERQ |
| 367 | OSM_MFE23 _spCD28 _CD28 (PYAPP-AYAA) | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR |

TABLE 7-continued

Amino Acid Sequences

| ID No | Component | Sequence |
|---|---|---|
|  | _CD40 CTP201 | SSYPLTFGAG TKLELKRAAA GSGGGSILVK QSPMLVAYDN AVNLSCKYSY NLFSREFRAS LHKGLDSAVE VCVVYGNYSQ QLQVYSKTGF NCDGKLGNES VTFYLQNLYV NQTDIYFCKI EVMYPPPYLD NEKSNGTIIH VKGKHLCPSP LFPGPSKPFW VLVVVGGVLA CYSLLVTVAF IIFWVRSKRS RLLHSDYMNM TPRRPGPTRK HYQAYAAPRD FAAYRSKKVA KKPTNKAPHP KQEPQEINFP DDLPGSNTAA PVQETLHGCQ PVTQEDGKES RISVQERQ |
| 368 | OSM_MFE23 _spCD28 _CD28 (YMNM-FMNM) _CD40 CTP202 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGGSILVK QSPMLVAYDN AVNLSCKYSY NLFSREFRAS LHKGLDSAVE VCVVYGNYSQ QLQVYSKTGF NCDGKLGNES VTFYLQNLYV NQTDIYFCKI EVMYPPPYLD NEKSNGTIIH VKGKHLCPSP LFPGPSKPFW VLVVVGGVLA CYSLLVTVAF IIFWVRSKRS RLLHSDFMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 369 | OSM_MFE23 _spCD28 _CD40 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGGSILVK QSPMLVAYDN AVNLSCKYSY NLFSREFRAS LHKGLDSAVE VCVVYGNYSQ QLQVYSKTGF NCDGKLGNES VTFYLQNLYV NQTDIYFCKI EVMYPPPYLD NEKSNGTIIH VKGKHLCPSP LFPGPSKPFW VLVVVGGVLA CYSLLVTVAF IIFWVKKVAK KPTNKAPHPK QEPQEINFPD DLPGSNTAAP VQETLHGCQP VTQEDGKESR ISVQERQ |
| 370 | OSM_MFE23 _spCD28 _CD137_CD 40 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGGSILVK QSPMLVAYDN AVNLSCKYSY NLFSREFRAS LHKGLDSAVE VCVVYGNYSQ QLQVYSKTGF NCDGKLGNES VTFYLQNLYV NQTDIYFCKI EVMYPPPYLD NEKSNGTIIH VKGKHLCPSP LFPGPSKPFW VLVVVGGVLA CYSLLVTVAF IIFWVRFSVV KRGRKKLLYI FKQPFMRPVQ TTQEEDGCSC RFPEEEEGGC EKKVAKKPTN KAPHPKQEPQ EINFPDDLPG SNTAAPVQET LHGCQPVTQE DGKESRISVQ ERQ |
| 371 | OSM_MFE23 _spCD28 _CD134_CD 40 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGGSILVK QSPMLVAYDN AVNLSCKYSY NLFSREFRAS LHKGLDSAVE VCVVYGNYSQ QLQVYSKTGF NCDGKLGNES VTFYLQNLYV NQTDIYFCKI EVMYPPPYLD NEKSNGTIIH VKGKHLCPSP LFPGPSKPFW VLVVVGGVLA CYSLLVTVAF IIFWVRRDQR LPPDAHKPPG GGSFRTPIQE EQADAHSTLA KIKKVAKKPT NKAPHPKQEP QEINFPDDLP GSNTAAPVQE TLHGCQPVTQ EDGKESRISV QERQ |
| 372 | OSM_MFE23 _spCD28 _CD2_CD40 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGGSILVK QSPMLVAYDN AVNLSCKYSY NLFSREFRAS LHKGLDSAVE VCVVYGNYSQ QLQVYSKTGF NCDGKLGNES VTFYLQNLYV NQTDIYFCKI EVMYPPPYLD NEKSNGTIIH VKGKHLCPSP LFPGPSKPFW VLVVVGGVLA CYSLLVTVAF IIFWVKRKKQ RSRRNDEELE TRAHRVATEE RGRKPHQIPA STPQNPATSQ HPPPPPGHRS QAPSHRPPPP GHRVQHQPQK RPPAPSGTQV HQQKGPPLPR PRVQPKPPHG AAENSLSPSS NKKVAKKPTN KAPHPKQEPQ EINFPDDLPG SNTAAPVQET LHGCQPVTQE DGKESRISVQ ERQ |
| 373 | OSM_MFE23 _spCD28 _GITR_CD4 0 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGGSILVK QSPMLVAYDN AVNLSCKYSY NLFSREFRAS LHKGLDSAVE VCVVYGNYSQ QLQVYSKTGF NCDGKLGNES |

TABLE 7-continued

Amino Acid Sequences

| ID No | Component | Sequence |
|---|---|---|
| | | VTFYLQNLYV NQTDIYFCKI EVMYPPPYLD NEKSNGTIIH VKGKHLCPSP |
| | | LFPGPSKPFW VLVVVGGVLA CYSLLVTVAF IIFWVQLGLH IWQLRSQCMW |
| | | PRETQLLLEV PPSTEDARSC QFPEEERGER SAEEKGRLGD LWVKKVAKKP |
| | | TNKAPHPKQE PQEINFPDDL PGSNTAAPVQ ETLHGCQPVT QEDGKESRIS |
| | | VQERQ |
| 374 | OSM_MFE23 _spCD28 _CD29_CD4 0 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGGSILVK QSPMLVAYDN AVNLSCKYSY NLFSREFRAS LHKGLDSAVE VCVVYGNYSQ QLQVYSKTGF NCDGKLGNES VTFYLQNLYV NQTDIYFCKI EVMYPPPYLD NEKSNGTIIH VKGKHLCPSP LFPGPSKPFW VLVVVGGVLA CYSLLVTVAF IIFWVKLLMI IHDRREFAKF EKEKMNAKWD TGENPIYKSA VTTVVNPKYE GKKKVAKKPT NKAPHPKQEP QEINFPDDLP GSNTAAPVQE TLHGCQPVTQ EDGKESRISV QERQ |
| 375 | OSM_MFE23 _spCD28 _CD150_CD 40 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGGSILVK QSPMLVAYDN AVNLSCKYSY NLFSREFRAS LHKGLDSAVE VCVVYGNYSQ QLQVYSKTGF NCDGKLGNES VTFYLQNLYV NQTDIYFCKI EVMYPPPYLD NEKSNGTIIH VKGKHLCPSP LFPGPSKPFW VLVVVGGVLA CYSLLVTVAF IIFWVRRRGK TNHYQTTVEK KSLTIYAQVQ KPGPLQKKLD SFPAQDPCTT IYVAATEPVP ESVQETNSIT VYASVTLPES KKVAKKPTNK APHPKQEPQE INFPDDLPGS NTAAPVQETL HGCQPVTQED GKESRISVQE RQ |
| 376 | OSM_MFE23 _spCD8_CD 40 CTP193 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGGSFVPV FLPAKPTTTP APRPPTPAPT IASQPLSLRP EACRPAAGGA VHTRGLDFAC DIYIWAPLAG TCGVLLLSLV ITLYCNHRNK KVAKKPTNKA PHPKQEPQEI NFPDDLPGSN TAAPVQETLH GCQPVTQEDG KESRISVQER Q |
| 377 | OSM_MFE23 _spCD8 _CD137_CD 40 CTP192 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGGSFVPV FLPAKPTTTP APRPPTPAPT IASQPLSLRP EACRPAAGGA VHTRGLDFAC DIYIWAPLAG TCGVLLLSLV ITLYCNHRNR FSVVKRGRKK LLYIFKQPFM RPVQTTQEED GCSCRFPEEE EGGCEKKVAK KPTNKAPHPK QEPQEINFPD DLPGSNTAAP VQETLHGCQP VTQEDGKESR ISVQERQ |
| 378 | OSM_MFE23 _spCD8 _CD134_CD 40 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGGSFVPV FLPAKPTTTP APRPPTPAPT IASQPLSLRP EACRPAAGGA VHTRGLDFAC DIYIWAPLAG TCGVLLLSLV ITLYCNHRNR RDQRLPPDAH KPPGGGSFRT PIQEEQADAH STLAKIKKVA KKPTNKAPHP KQEPQEINFP DDLPGSNTAA PVQETLHGCQ PVTQEDGKSR ISVQERQ |
| 379 | OSM_MFE23 _spCD8 _CD2_CD40 CTP191 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGGSFVPV FLPAKPTTTP APRPPTPAPT IASQPLSLRP EAGRPAAGGA VHTRGLDFAC DIYIWAPLAG TCGVLLLSLV ITLYCNHRNK RKKQRSRRND EELETRAHRV ATEERGRKPH QIPASTPQNP ATSQHPPPPP GHRSQAPSHR PPPPGHRVQH QPQKRPPAPS GTQVHQQKGP PLPRPRVQPK PPHGAAENSL SPSSNKKVAK KPTNKAPHPK QEPQEINFPD DLPGSNTAAP VQETLHGCQP VTQEDGKESR ISVQERQ |

TABLE 7-continued

Amino Acid Sequences

| ID No | Component | Sequence |
|---|---|---|
| 380 | OSM_MFE23 _spCD8 _GITR_CD4 0 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGGSGFVPV FLPAKPTTTP APRPPTPAPT IASQPLSLRP EAGRPAAGGA VHTRGLDFAC DIYIWAPLAG TCGVLLLSLV ITLYCNHRNQ LGLHIWQLRS QCMWPRETQL LLEVPPSTED ARSCQFPEEE RGERSAEEKG RLGDLWVKKV AKKPTNKAPH PKQEPQEINF PDDLPGSNTA APVQETLHGC QPVTQEDGKE SRISVQERQ |
| 381 | OSM_MFE23 _spCD8 _CD29_CD4 0 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGGSGFVPV FLPAKPTTTP APRPPTPAPT IASQPLSLRP EAGRPAAGGA VHTRGLDFAC DIYIWAPLAG TCGVLLLSLV ITLYCNHRNK LLMIIHDRRE FAKFEKEKMN AKWDTGENPI YKSAVTTVVN PKYEGKKKVA KKPTNKAPHP KQEPQEINFP DDLPGSNTAA PVQETLHGCQ PVTQEDGKES RISVQERQ |
| 382 | OSM_MFE23 _spCD8 _CD150_CD 40 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGGSGFVPV FLPAKPTTTP APRPPTPAPT IASQPLSLRP EAGRPAAGGA VHTRGLDFAC DIYIWAPLAG TCGVLLLSLV ITLYCNHRNR RRGKTNHYQT TVEKKSLTIY AQVQKPGPLQ KKLDSFPAQD PCTTIYVAAT EPVPESVQET NSITVYASVT LPESKKVAKK PTNKAPHPKQ EPQEINFPDD LPGSNTAAPV QETLHGCQPV TQEDGKESRI SVQERQ |
| 383 | OSM_MFE23 _spIG4 _CD28_CD4 0 CTP203 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGGSESKY GPPCPSCPAP EFLGGPSVFL FPPKPKDTLM ISRTPEVTCV VVDVSQEDPE VQFNWYVDGV EVHNAKTKPR EEQFNSTYRV VSVLTVLHQD WLNGKEYKCK VSNKGLPSSI EKTISKAKGQ PREPQVYTLP PSQEEMTKNQ VSLTCLVKGF YPSDIAVEWE SNGQPENNYK TTPPVLDSDG SFFLYSRLTV DKSRWQEGNV FSCSVMHEAL HNHYTQKSLS LSLGKMFWVL VVVGGVLACY SLLVTVAFII FWVRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 384 | OSM_MFE23 _spIG4_CD 40 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGGSESKY GPPCPSCPAP EFLGGPSVFL FPPKPKDTLM ISRTPEVTCV VVDVSQEDPE VQFNWYVDGV EVHNAKTKPR EEQFNSTYRV VSVLTVLHQD WLNGKEYKCK VSNKGLPSSI EKTISKAKGQ PREPQVYTLP PSQEEMTKNQ VSLTCLVKGF YPSDIAVEWE SNGQPENNYK TTPPVLDSDG SFFLYSRLTV DKSRWQEGNV FSCSVMHEAL HNHYTQKSLS LSLGKMFWVL VVVGGVLACY SLLVTVAFII FWVKKVAKKP TNKAPHPKQE PQEINFPDDL PGSNTAAPVQ ETLHGCQPVT QEDGKESRIS VQERQ |
| 385 | OSM_MFE23 _spIG4 _CD137_CD 40 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGGSESKY GPPCPSCPAP EFLGGPSVFL FPPKPKDTLM ISRTPEVTCV VVDVSQEDPE VQFNWYVDGV EVHNAKTKPR EEQFNSTYRV VSVLTVLHQD WLNGKEYKCK VSNKGLPSSI EKTISKAKGQ PREPQVYTLP PSQEEMTKNQ VSLTCLVKGF YPSDIAVEWE SNGQPENNYK TTPPVLDSDG SFFLYSRLTV DKSRWQEGNV FSCSVMHEAL HNHYTQKSLS LSLGKMFWVL VVVGGVLACY SLLVTVAFII FWVKKVAKKP TNKAPHPKQE PQEINFPDDL PGSNTAAPVQ ETLHGCQPVT QEDGKESRIS VQERQ |

TABLE 7-continued

Amino Acid Sequences

| ID No | Component | Sequence |
|---|---|---|
| 386 | OSM_MFE23 _spIG4 _CD134_CD 40 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGSGESKY GPPCPSCPAP EFLGGPSVFL FPPKPKDTLM ISRTPEVTCV VVDVSQEDPE VQFNWYVDGV EVHNAKTKPR EEQFNSTYRV VSVLTVLHQD WLNGKEYKCK VSNKGLPSSI EKTISKAKGQ PREPQVYTLP PSQEEMTKNQ VSLTCLVKGF YPSDIAVEWE SNGQPENNYK TTPPVLDSDG SFFLYSRLTV DKSRWQEGNV FSCSVMHEAL HNHYTQKSLS LSLGKMFWVL VVVGGVLACY SLLVTVAFII FWVRRDQRLP PDAHKPPGGG SFRTPIQEEQ ADAHSTLAKI KKVAKKPTNK APHPKQEPQE INFPDDLPGS NTAAPVQETL HGCQPVTQED GKESRISVQE RQ |
| 387 | OSM_MFE23 _spIG4 _CD2_CD40 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGSGESKY GPPCPSCPAP EFLGGPSVFL FPPKPKDTLM ISRTPEVTCV VVDVSQEDPE VQFNWYVDGV EVHNAKTKPR EEQFNSTYRV VSVLTVLHQD WLNGKEYKCK VSNKGLPSSI EKTISKAKGQ PREPQVYTLP PSQEEMTKNQ VSLTCLVKGF YPSDIAVEWE SNGQPENNYK TTPPVLDSDG SFFLYSRLTV DKSRWQEGNV FSCSVMHEAL HNHYTQKSLS LSLGKMFWVL VVVGGVLACY SLLVTVAFII FWVKRKKQRS RRNDEELETR AHRVATEERG RKPHQIPAST PQNPATSQHP PPPPGHRSQA PSHRPPPPGH RVQHQPQKRP PAPSGTQVHQ QKGPPLPRPR VQPKPPHGAA ENSLSPSSNK KVAKKPTNKA PHPKQEPQEI NFPDDLPGSN TAAPVQETLH GCQPVTQEDG KESRISVQER Q |
| 388 | OSM_MFE23 _spIG4 _GITR_CD4 0 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGSGESKY GPPCPSCPAP EFLGGPSVFL FPPKPKDTLM ISRTPEVTCV VVDVSQEDPE VQFNWYVDGV EVHNAKTKPR EEQFNSTYRV VSVLTVLHQD WLNGKEYKCK VSNKGLPSSI EKTISKAKGQ PREPQVYTLP PSQEEMTKNQ VSLTCLVKGF YPSDIAVEWE SNGQPENNYK TTPPVLDSDG SFFLYSRLTV DKSRWQEGNV FSCSVMHEAL HNHYTQKSLS LSLGKMFWVL VVVGGVLACY SLLVTVAFII FWVQLGLHIW QLRSQCMWPR ETQLLLEVPP STEDARSCQF PEEERGERSA EEKGRLGDLW VKKVAKKPTN KAPHPKQEPQ EINFPDDLPG SNTAAPVQET LHGCQPVTQE DGKESRISVQ ERQ |
| 389 | OSM_MFE23 _spIG4 _CD29_CD4 0 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGSGESKY GPPCPSCPAP EFLGGPSVFL FPPKPKDTLM ISRTPEVTCV VVDVSQEDPE VQFNWYVDGV EVHNAKTKPR EEQFNSTYRV VSVLTVLHQD WLNGKEYKCK VSNKGLPSSI EKTISKAKGQ PREPQVYTLP PSQEEMTKNQ VSLTCLVKGF YPSDIAVEWE SNGQPENNYK TTPPVLDSDG SFFLYSRLTV DKSRWQEGNV FSCSVMHEAL HNHYTQKSLS LSLGKMFWVL VVVGGVLACY SLLVTVAFII FWVKLLMIIH DRREFAKFEK EKMNAKWDTG ENPIYKSAVT TVVNPKYEGK KKVAKKPTNK APHPKQEPQE INFPDDLPGS NTAAPVQETL HGCQPVTQED GKESRISVQE RQ |
| 390 | OSM_MFE23 _spIG4 _CD150_CD 40 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGSGESKY GPPCPSCPAP EFLGGPSVFL FPPKPKDTLM ISRTPEVTCV VVDVSQEDPE VQFNWYVDGV EVHNAKTKPR EEQFNSTYRV VSVLTVLHQD WLNGKEYKCK VSNKGLPSSI EKTISKAKGQ PREPQVYTLP PSQEEMTKNQ VSLTCLVKGF YPSDIAVEWE SNGQPENNYK TTPPVLDSDG SFFLYSRLTV DKSRWQEGNV FSCSVMHEAL HNHYTQKSLS LSLGKMFWVL VVVGGVLACY SLLVTVAFII FWVRRRGKTN HYQTTVEKKS LTIYAQVQKP GPLQKKLDSF PAQDPCTTIY VAATEPVPES VQETNSITVY ASVTLPESKK VAKKPTNKAP HPKQEPQEIN FPDDLPGSNT AAPVQETLHG CQPVTQEDGK ESRISVQERQ |

TABLE 7-continued

Amino Acid Sequences

| ID No | Component | Sequence |
|---|---|---|
| 391 | OSM_MFE23 _spIG4 _CD40 _tandem | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGGSESKY GPPCPSCPAP EFLGGPSVFL FPPKPKDTLM ISRTPEVTCV VVDVSQEDPE VQFNWYVDGV EVHNAKTKPR EEQFNSTYRV VSVLTVLHQD WLNGKEYKCK VSNKGLPSSI EKTISKAKGQ PREPQVYTLP PSQEEMTKNQ VSLTCLVKGF YPSDIAVEWE SNGQPENNYK TTPPVLDSDG SFFLYSRLTV DKSRWQEGNV FSCSVMHEAL HNHYTQKSLS LSLGKMFWVL VVVGGVLACY SLLVTVAFII FWVAKKPTNK APHPKQEPQE INFPDDLPGS NTAAPVQETL HGCQPVTQED GKESRISVQE RQKKVAKKPT NKAPHPKQEP QEINFPDDLP GSNTAAPVQE TLHGCQPVTQ EDGKESRISV QERQKKVA |
| 392 | OSM_MFE23 _spIG4 _CD40_P22 7A | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGGSESKY GPPCPSCPAP EFLGGPSVFL FPPKPKDTLM ISRTPEVTCV VVDVSQEDPE VQFNWYVDGV EVHNAKTKPR EEQFNSTYRV VSVLTVLHQD WLNGKEYKCK VSNKGLPSSI EKTISKAKGQ PREPQVYTLP PSQEEMTKNQ VSLTCLVKGF YPSDIAVEWE SNGQPENNYK TTPPVLDSDG SFFLYSRLTV DKSRWQEGNV FSCSVMHEAL HNHYTQKSLS LSLGKMFWVL VVVGGVLACY SLLVTVAFII FWVKKVAKKP TNKAAHPKQE PQEINFPDDL PGSNTAAPVQ ETLHGCQPVT QEDGKESRIS VQERQ |
| 393 | OSM_MFE23 _PD1 _sCD28TM_ CD28 _CD40 CTP204 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGSGRPGW FLDSPDRPWN PPTFSPALLV VTEGDNATFT CSFSNTSESF VLNWYRMSPS NQTDKLAAFP EDRSQPGQDC RFRVTQLPNG RDFHMSVVRA RRNDSGTYLC GAISLAPKAQ IKESLRAELR VTERRAEVPT AHCPSPLFPG PSKPFWVLVV VGGVLACYSL LVTVAFIIFW VRSKRSRLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |
| 394 | OSM_MFE23 _PD1 _sCD28TM_ CD40 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGSGRPGW FLDSPDRPWN PPTFSPALLV VTEGDNATFT CSFSNTSESF VLNWYRMSPS NQTDKLAAFP EDRSQPGQDC RFRVTQLPNG RDFHMSVVRA RRNDSGTYLC GAISLAPKAQ IKESLRAELR VTERRAEVPT AHCPSPLFPG PSKPFWVLVV VGGVLACYSL LVTVAFIIFW VKKVAKKPTN KAPHPKQEPQ EINFPDDLPG SNTAAPVQET LHGCQPVTQE DGKESRISVQ ERQ |
| 395 | OSM_MFE23 _TIGIT _sCD28TM_ CD28 _CD40 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGSGMMTG TIETTGNISA EKGGSIILQC HLSSTTAQVT QVNWEQQDQL LAICNADLGW HISPSFKDRV APGPGLGLTL QSLTVNDTGE YFCIYHTYPD GTYTGRIFLE VLESSVAEHG ARFQIPFWVL VVVGGVLACY SLLVTVAFII FWVRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 396 | OSM_MFE23 _TIGIT _sCD28TM_ CD40 | MGVLLTQRTL LSLVLALLFP SMASMQVQLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGSGMMTG TIETTGNISA EKGGSIILQC HLSSTTAQVT QVNWEQQDQL LAICNADLGW HISPSFKDRV APGPGLGLTL QSLTVNDTGE YFCIYHTYPD GTYTGRIFLE VLESSVAEHG ARFQIPFWVL VVVGGVLACY SLLVTVAFII FWVKKVAKKP TNKAPHPKQE PQEINFPDDL PGSNTAAPVQ ETLHGCQPVT QEDGKESRIS VQERQ |

TABLE 7-continued

Amino Acid Sequences

| ID No | Component | Sequence |
|---|---|---|
| 397 | OSM_MOV19_spCD28_CD28_CD40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGIL VKQSPMLVAY DNAVNLSCKY SYNLFSREFR ASLHKGLDSA VEVCVVYGNY SQQLQVYSKT GFNCDGKLGN ESVTFYLQNL YVNQTDIYFC KIEVMYPPPY LDNEKSNGTI IHVKGKHLCP SPLFPGPSKP FWVLVVVGGV LACYSLLVTV AFIIFWVRSK RSRLLHSDYM NMTPRRPGPT RKHYQPYAPP RDFAAYRSKK VAKKPTNKAP HPKQEPQEIN FPDDLPGSNT AAPVQETLHG CQPVTQEDGK ESRISVQERQ |
| 398 | OSM_MOV19_spCD28_CD40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGIL VKQSPMLVAY DNAVNLSCKY SYNLFSREFR ASLHKGLDSA VEVCVVYGNY SQQLQVYSKT GFNCDGKLGN ESVTFYLQNL YVNQTDIYFC KIEVMYPPPY LDNEKSNGTI IHVKGKHLCP SPLFPGPSKP FWVLVVVGGV LACYSLLVTV AFIIFWVKKV AKKPTNKAPH PKQEPQEINF PDDLPGSNTA APVQETLHGC QPVTQEDGKE SRISVQERQ |
| 399 | OSM_MOV19_spCD28_CD137_CD40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGIL VKQSPMLVAY DNAVNLSCKY SYNLFSREFR ASLHKGLDSA VEVCVVYGNY SQQLQVYSKT GFNCDGKLGN ESVTFYLQNL YVNQTDIYFC KIEVMYPPPY LDNEKSNGTI IHVKGKHLCP SPLFPGPSKP FWVLVVVGGV LACYSLLVTV AFIIFWVRFS VVKRGRKKLL YIFKQPFMRP VQTTQEEDGC SCRFPEEEEG GCEKKVAKKP TNKAPHPKQE PQEINFPDDL PGSNTAAPVQ ETLHGCQPVT QEDGKESRIS VQERQ |
| 400 | OSM_MOV19_spCD28_CD134_CD40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGIL VKQSPMLVAY DNAVNLSCKY SYNLFSREFR ASLHKGLDSA VEVCVVYGNY SQQLQVYSKT GFNCDGKLGN ESVTFYLQNL YVNQTDIYFC KIEVMYPPPY LDNEKSNGTI IHVKGKHLCP SPLFPGPSKP FWVLVVVGGV LACYSLLVTV AFIIFWVRRD QRLPPDAHKP PGGGSFRTPI QEEQADAHST LAKIKKVAKK PTNKAPHPKQ EPQEINFPDD LPGSNTAAPV QETLHGCQPV TQEDGKESRI SVQERQ |
| 401 | OSM_MOV19_spCD28_CD2_CD40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGIL VKQSPMLVAY DNAVNLSCKY SYNLFSREFR ASLHKGLDSA VEVCVVYGNY SQQLQVYSKT GFNCDGKLGN ESVTFYLQNL YVNQTDIYFC KIEVMYPPPY LDNEKSNGTI IHVKGKHLCP SPLFPGPSKP FWVLVVVGGV LACYSLLVTV AFIIFWVKRK KQRSRRNDEE LETRAHRVAT EERGRKPHQI PASTPQNPAT SQHPPPPPGH RSQAPSHRPP PPGHRVQHQP QKRPPAPSGT QVHQQKGPPL PRPRVQPKPP HGAAENSLSP SSNKKVAKKP TNKAPHPKQE PQEINFPDDL PGSNTAAPVQ ETLHGCQPVT QEDGKESRIS VQERQ |
| 402 | OSM_MOV19_spCD28_GITR_CD40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGIL VKQSPMLVAY DNAVNLSCKY SYNLFSREFR ASLHKGLDSA VEVCVVYGNY SQQLQVYSKT GFNCDGKLGN ESVTFYLQNL YVNQTDIYFC KIEVMYPPPY LDNEKSNGTI IHVKGKHLCP SPLFPGPSKP FWVLVVVGGV LACYSLLVTV AFIIFWVQLG LHIWQLRSQC MWPRETQLLL EVPPSTEDAR SCQFPEEERG ERSAEEKGRL GDLWVKKVAK KPTNKAPHPK QEPQEINFPD DLPGSNTAAP VQETLHGCQP VTQEDGKESR ISVQERQ |

TABLE 7-continued

Amino Acid Sequences

| ID No | Component | Sequence |
|---|---|---|
| 403 | OSM_MOV19_spCD28_CD29_CD40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGIL VKQSPMLVAY DNAVNLSCKY SYNLFSREFR ASLHKGLDSA VEVCVVYGNY SQQLQVYSKT GFNCDGKLGN ESVTFYLQNL YVNQTDIYFC KIEVMYPPPY LDNEKSNGTI IHVKGKHLCP SPLFPGPSKP FWVLVVVGGV LACYSLLVTV AFIIFWVKLL MIIHDRREFA KFEKEKMNAK WDTGENPIYK SAVTTVVNPK YEGKKKVAKK PTNKAPHPKQ EPQEINFPDD LPGSNTAAPV QETLHGCQPV TQEDGKESRI SVQERQ |
| 404 | OSM_MOV19_spCD28_CD150_CD40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGIL VKQSPMLVAY DNAVNLSCKY SYNLFSREFR ASLHKGLDSA VEVCVVYGNY SQQLQVYSKT GFNCDGKLGN ESVTFYLQNL YVNQTDIYFC KIEVMYPPPY LDNEKSNGTI IHVKGKHLCP SPLFPGPSKP FWVLVVVGGV LACYSLLVTV AFIIFWVRRR GKTNHYQTTV EKKSLTIYAQ VQKPGPLQKK LDSFPAQDPC TTIYVAATEP VPESVQETNS ITVYASVTLP ESKKVAKKPT NKAPHPKQEP QEINFPDDLP GSNTAAPVQE TLHGCQPVTQ EDGKESRISV QERQ |
| 405 | OSM_MOV19_spCD8_CD28_CD40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGFV PVFLPAKPTT TPAPRPPTPA PTIASQPLSL RPEACRPAAG GAVHTRGLDF ACDIYIWAPL AGTCGVLLLS LVITLYCNHR NRSKRSRLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |
| 406 | OSM_MOV19_spCD8_CD40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGFV PVFLPAKPTT TPAPRPPTPA PTIASQPLSL RPEACRPAAG GAVHTRGLDF ACDIYIWAPL AGTCGVLLLS LVITLYCNHR NKKVAKKPTN KAPHPKQEPQ EINFPDDLPG SNTAAPVQET LHGCQPVTQE DGKESRISVQ ERQ |
| 407 | OSM_MOV19_spCD8_CD137_CD40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGFV PVFLPAKPTT TPAPRPPTPA PTIASQPLSL RPEACRPAAG GAVHTRGLDF ACDIYIWAPL AGTCGVLLLS LVITLYCNHR NRFSVVKRGR KKLLYIFKQP FMRPVQTTQE EDGCSCRFPE EEEGGCEKKV AKKPTNKAPH PKQEPQEINF PDDLPGSNTA APVQETLHGC QPVTQEDGKE SRISVQERQ |
| 408 | OSM_MOV19_spCD8_CD134_CD40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGFV PVFLPAKPTT TPAPRPPTPA PTIASQPLSL RPEACRPAAG GAVHTRGLDF ACDIYIWAPL AGTCGVLLLS LVITLYCNHR NRRDQRLPPD AHKPPGGGSF RTPIQEEQAD AHSTLAKIKK VAKKPTNKAP HPKQEPQEIN FPDDLPGSNT AAPVQETLHG CQPVTQEDGK SRISVQERQ |
| 409 | OSM_MOV19_spCD8_CD2_CD40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGFV PVFLPAKPTT TPAPRPPTPA PTIASQPLSL RPEACRPAAG GAVHTRGLDF ACDIYIWAPL AGTCGVLLLS |

TABLE 7-continued

Amino Acid Sequences

| ID No | Component | Sequence |
|---|---|---|
| | | LVITLYCNHR NKRKKQRSRR NDEELETRAH RVATEERGRK PHQIPASTPQ NPATSQHPPP PPGHRSQAPS HRPPPPGHRV QHQPQKRPPA PSGTQVHQQK GPPLPRPRVQ PKPPHGAAEN SLSPSSNKKV AKKPTNKAPH PKQEPQEINF PDDLPGSNTA APVQETLHGC QPVTQEDGKE SRISVQERQ |
| 410 | OSM_MOV19 _spCD8_GI TR_CD40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGFV PVFLPAKPTT TPAPRPPTPA PTIASQPLSL RPEACRPAAG GAVHTRGLDF ACDIYIWAPL AGTCGVLLLS LVITLYCNHR NQLGLHIWQL RSQCMWPRET QLLLEVPPST EDARSCQFPE EERGERSAEE KGRLGDLWVK KVAKKPTNKA PHPKQEPQEI NFPDDLPGSN TAAPVQETLH GCQPVTQEDG KESRISVQER Q |
| 411 | OSM_MOV19 _spCD8 _CD29_CD4 0 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGFV PVFLPAKPTT TPAPRPPTPA PTIASQPLSL RPEACRPAAG GAVHTRGLDF ACDIYIWAPL AGTCGVLLLS LVITLYCNHR NKLLMIIHDR REFAKFEKEK MNAKWDTGEN PIYKSAVTTV VNPKYEGKKK VAKKPTNKAP HPKQEPQEIN FPDDLPGSNT AAPVQETLHG CQPVTQEDGK ESRISVQERQ |
| 412 | OSM_MOV19 _spCD8 _CD150_CD 40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGFV PVFLPAKPTT TPAPRPPTPA PTIASQPLSL RPEACRPAAG GAVHTRGLDF ACDIYIWAPL AGTCGVLLLS LVITLYCNHR NRRRGKTNHY QTTVEKKSLT IYAQVQKPGP LQKKLDSFPA QDPCTTIYVA ATEPVPESVQ ETNSITVYAS VTLPESKKVA KKPTNKAPHP KQEPQEINFP DDLPGSNTAA PVQETLHGCQ PVTQEDGKES RISVQERQ |
| 413 | OSM_MOV19 _spIG4 _CD28_CD4 0 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGES KYGPPCPSCP APEFLGGPSV FLFPPKPKDT LMISRTPEVT CVVVDVSQED PEVQFNWYVD GVEVHNAKTK PREEQFNSTY RVVSVLTVLH QDWLNGKEYK CKVSNKGLPS SIEKTISKAK GQPREPQVYT LPPSQEEMTK NQVSLTCLVK GFYPSDIAVE WESNGQPENN YKTTPPVLDS DGSFFLYSRL TVDKSRWQEG NVFSCSVMHE ALHNHYTQKS LSLSLGKMFW VLVVVGGVLA CYSLLVTVAF IIFWVRSKRS RLLHSDYMNM TPRRPGPTRK HYQPYAPPRD FAAYRSKKVA KKPTNKAPHP KQEPQEINFP DDLPGSNTAA PVQETLHGCQ PVTQEDGKES RISVQERQ |
| 414 | OSM_MOV19 _spIG4_CD 40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGES KYGPPCPSCP APEFLGGPSV FLFPPKPKDT LMISRTPEVT CVVVDVSQED PEVQFNWYVD GVEVHNAKTK PREEQFNSTY RVVSVLTVLH QDWLNGKEYK CKVSNKGLPS SIEKTISKAK GQPREPQVYT LPPSQEEMTK NQVSLTCLVK GFYPSDIAVE WESNGQPENN YKTTPPVLDS DGSFFLYSRL TVDKSRWQEG NVFSCSVMHE ALHNHYTQKS LSLSLGKMFW VLVVVGGVLA CYSLLVTVAF IIFWVKKVAK KPTNKAPHPK QEPQEINFPD DLPGSNTAAP VQETLHGCQP VTQEDGKESR ISVQERQ |
| 415 | OSM_MOV19 _spIG4 _CD137_CD 40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGES KYGPPCPSCP APEFLGGPSV FLFPPKPKDT LMISRTPEVT CVVVDVSQED PEVQFNWYVD GVEVHNAKTK PREEQFNSTY RVVSVLTVLH QDWLNGKEYK CKVSNKGLPS SIEKTISKAK GQPREPQVYT LPPSQEEMTK NQVSLTCLVK GFYPSDIAVE WESNGQPENN YKTTPPVLDS DGSFFLYSRL TVDKSRWQEG NVFSCSVMHE ALHNHYTQKS |

TABLE 7-continued

Amino Acid Sequences

| ID No | Component | Sequence |
|---|---|---|
| | | LSLSLGKMFW VLVVVGGVLA CYSLLVTVAF IIFWVKKVAK KPTNKAPHPK |
| | | QEPQEINFPD DLPGSNTAAP VQETLHGCQP VTQEDGKESR ISVQERQ |
| 416 | OSM_MOV19_spIG4_CD134_CD40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGES KYGPPCPSCP APEFLGGPSV FLFPPKPKDT LMISRTPEVT CVVVDVSQED PEVQFNWYVD GVEVHNAKTK PREEQFNSTY RVVSVLTVLH QDWLNGKEYK CKVSNKGLPS SIEKTISKAK GQPREPQVYT LPPSQEEMTK NQVSLTCLVK GFYPSDIAVE WESNGQPENN YKTTPPVLDS DGSFFLYSRL TVDKSRWQEG NVFSCSVMHE ALHNHYTQKS LSLSLGKMFW VLVVVGGVLA CYSLLVTVAF IIFWVRRDQR LPPDAHKPPG GGSFRTPIQE EQADAHSTLA KIKKVAKKPT NKAPHPKQEP QEINFPDDLP GSNTAAPVQE TLHGCQPVTQ EDGKESRISV QERQ |
| 417 | OSM_MOV19_spIG4_CD2_CD40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGES KYGPPCPSCP APEFLGGPSV FLFPPKPKDT LMISRTPEVT CVVVDVSQED PEVQFNWYVD GVEVHNAKTK PREEQFNSTY RVVSVLTVLH QDWLNGKEYK CKVSNKGLPS SIEKTISKAK GQPREPQVYT LPPSQEEMTK NQVSLTCLVK GFYPSDIAVE WESNGQPENN YKTTPPVLDS DGSFFLYSRL TVDKSRWQEG NVFSCSVMHE ALHNHYTQKS LSLSLGKMFW VLVVVGGVLA CYSLLVTVAF IIFWVKRKKQ RSRRNDEELE TRAHRVATEE RGRKPHQIPA STPQNPATSQ HPPPPPGHRS QAPSHRPPPP GHRVQHQPQK RPPAPSGTQV HQQKGPPLPR PRVQPKPPHG AAENSLSPSS NKKVAKKPTN KAPHPKQEPQ EINFPDDLPG SNTAAPVQET LHGCQPVTQE DGKESRISVQ ERQ |
| 418 | OSM_MOV19_spIG4_GITR_CD40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGES KYGPPCPSCP APEFLGGPSV FLFPPKPKDT LMISRTPEVT CVVVDVSQED PEVQFNWYVD GVEVHNAKTK PREEQFNSTY RVVSVLTVLH QDWLNGKEYK CKVSNKGLPS SIEKTISKAK GQPREPQVYT LPPSQEEMTK NQVSLTCLVK GFYPSDIAVE WESNGQPENN YKTTPPVLDS DGSFFLYSRL TVDKSRWQEG NVFSCSVMHE ALHNHYTQKS LSLSLGKMFW VLVVVGGVLA CYSLLVTVAF IIFWVQLGLH IWQLRSQCMW PRETQLLLEV PPSTEDARSC QFPEEERGER SAEEKGRLGD LWVKKVAKKP TNKAPHPKQE PQEINFPDDL PGSNTAAPVQ ETLHGCQPVT QEDGKESRIS VQERQ |
| 419 | OSM_MOV19_spIG4_CD29_CD40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGES KYGPPCPSCP APEFLGGPSV FLFPPKPKDT LMISRTPEVT CVVVDVSQED PEVQFNWYVD GVEVHNAKTK PREEQFNSTY RVVSVLTVLH QDWLNGKEYK CKVSNKGLPS SIEKTISKAK GQPREPQVYT LPPSQEEMTK NQVSLTCLVK GFYPSDIAVE WESNGQPENN YKTTPPVLDS DGSFFLYSRL TVDKSRWQEG NVFSCSVMHE ALHNHYTQKS LSLSLGKMFW VLVVVGGVLA CYSLLVTVAF IIFWVKLLMI IHDRREFAKF EKEKMNAKWD TGENPIYKSA VTTVVNPKYE GKKKVAKKPT NKAPHPKQEP QEINFPDDLP GSNTAAPVQE TLHGCQPVTQ EDGKESRISV QERQ |
| 420 | OSM_MOV19_spIG4_CD150_CD40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGES KYGPPCPSCP APEFLGGPSV FLFPPKPKDT LMISRTPEVT CVVVDVSQED PEVQFNWYVD GVEVHNAKTK PREEQFNSTY RVVSVLTVLH QDWLNGKEYK CKVSNKGLPS SIEKTISKAK GQPREPQVYT LPPSQEEMTK NQVSLTCLVK GFYPSDIAVE WESNGQPENN YKTTPPVLDS DGSFFLYSRL TVDKSRWQEG NVFSCSVMHE ALHNHYTQKS LSLSLGKMFW VLVVVGGVLA CYSLLVTVAF IIFWVRRRGK TNHYQTTVEK KSLTIYAQVQ KPGPLQKKLD SFPAQDPCTT IYVAATEPVP ESVQETNSIT |

TABLE 7-continued

Amino Acid Sequences

| ID No | Component | Sequence |
|---|---|---|
| | | VYASVTLPES KKVAKKPTNK APHPKQEPQE INFPDDLPGS NTAAPVQETL HGCQPVTQED GKESRISVQE RQ |
| 421 | OSM_MOV19 _spIG4 _CD40 _tandem | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGES KYGPPCPSCP APEFLGGPSV FLFPPKPKDT LMISRTPEVT CVVVDVSQED PEVQFNWYVD GVEVHNAKTK PREEQFNSTY RVVSVLTVLH QDWLNGKEYK CKVSNKGLPS SIEKTISKAK GQPREPQVYT LPPSQEEMTK NQVSLTCLVK GFYPSDIAVE WESNGQPENN YKTTPPVLDS DGSFFLYSRL TVDKSRWQEG NVFSCSVMHE ALHNHYTQKS LSLSLGKMFW VLVVVGGVLA CYSLLVTVAF IIFWVAKKPT NKAPHPKQEP QEINFPDDLP GSNTAAPVQE TLHGCQPVTQ EDGKESRISV QERQKKVAKK PTNKAPHPKQ EPQEINFPDD LPGSNTAAPV QETLHGCQPV TQEDGKESRI SVQERQKKVA |
| 422 | OSM_MOV19 _spIG4 _CD40_P22 7A | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGES KYGPPCPSCP APEFLGGPSV FLFPPKPKDT LMISRTPEVT CVVVDVSQED PEVQFNWYVD GVEVHNAKTK PREEQFNSTY RVVSVLTVLH QDWLNGKEYK CKVSNKGLPS SIEKTISKAK GQPREPQVYT LPPSQEEMTK NQVSLTCLVK GFYPSDIAVE WESNGQPENN YKTTPPVLDS DGSFFLYSRL TVDKSRWQEG NVFSCSVMHE ALHNHYTQKS LSLSLGKMFW VLVVVGGVLA CYSLLVTVAF IIFWVKKVAK KPTNKAAHPK QEPQEINFPD DLPGSNTAAP VQETLHGCQP VTQEDGKESR ISVQERQ |
| 423 | PD1_PD1 _sCD28TM _CD28_CD4 0 (dimeric) CTP188 | MQIPQAPWPV VWAVLQLGWR PGWFLDSPDR PWNPPTFSPA LLVVTEGDNA TFTCSFSNTS ESFVLNWYRM SPSNQTDKLA AFPEDRSQPG QDCRFRVTQL PNGRDFHMSV VRARRNDSGT YLCGAISLAP KAQIKESLRA ELRVTERRAE VPTAHCPSPL FPGPSKPFWV LVVVGGVLAC YSLLVTVAFI IFWVRSKRSR LLHSDYMNMT PRRPGPTRKH YQPYAPPRDF AAYRSKKVAK KPTNKAPHPK QEPQEINFPD DLPGSNTAAP VQETLHGCQP VTQEDGKESR ISVQERQ |
| 424 | PD1_PD1 _sCD28TM_ CD40 | MQIPQAPWPV VWAVLQLGWR PGWRPGWFLD SPDRPWNPPT FSPALLVVTE GDNATFTCSF SNTSESFVLN WYRMSPSNQT DKLAAFPEDR SQPGQDCRFR VTQLPNGRDF HMSVVRARRN DSGTYLCGAI SLAPKAQIKE SLRAELRVTE RRAEVPTAHC PSPLFPGPSK PFWVLVVVGG VLACYSLLVT VAFIIFWVKK VAKKPTNKAP HPKQEPQEIN FPDDLPGSNT AAPVQETLHG CQPVTQEDGK ESRISVQERQ |
| 425 | TIGIT _TIGIT _CD28TM _CD28_CD4 0 | MRWCLLLIWA QGLRQAPLAS GMMTGTIETT GNISAEKGGS IILQCHLSST TAQVTQVNWE QQDQLLAICN ADLGWHISPS FKDRVAPGPG LGLTLQSLTV NDTGEYFCIY HTYPDGTYTG RIFLEVLESS VAEHGARFQI PFWVLVVVGG VLACYSLLVT VAFIIFWVRS KRSRLLHSDY MNMTPRRPGP TRKHYQPYAP PRDFAAYRSK KVAKKPTNKA PHPKQEPQEI NFPDDLPGSN TAAPVQETLH GCQPVTQEDG KESRISVQER Q |
| 426 | TIGIT _TIGIT _CD28TM _CD40 | MRWCLLLIWA QGLRQAPLAS GMMTGTIETT GNISAEKGGS IILQCHLSST TAQVTQVNWE QQDQLLAICN ADLGWHISPS FKDRVAPGPG LGLTLQSLTV NDTGEYFCIY HTYPDGTYTG RIFLEVLESS VAEHGARFQI PFWVLVVVGG VLACYSLLVT VAFIIFWVKK VAKKPTNKAP HPKQEPQEIN FPDDLPGSNT AAPVQETLHG CQPVTQEDGK ESRISVQERQ |
| 427 | OSM_MOV19 _PD1 sCD28TM _CD28 _CD40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ KPGQQPKLLI YRASNLEAGV PTRFSGSGSK TDFTLNIHPV EEEDAATYYC QQSREYPYTF GGGTKLEIKA AAGSGGSGRP GWFLDSPDRP WNPPTFSPAL LVVTEGDNAT FTCSFSNTSE SFVLNWYRMS PSNQTDKLAA FPEDRSQPGQ DCRFRVTQLP NGRDFHMSVV RARRNDSGTY LCGAISLAPK AQIKESLRAE LRVTERRAEV PTAHCPSPLF PGPSKPFWVL VVVGGVLACY SLLVTVAFII FWVRSKRSRL LHSDYMNMTP RRPGPTRKHY QPYAPPRDFA AYRSKKVAKK PTNKAPHPKQ EPQEINFPDD LPGSNTAAPV QETLHGCQPV TQEDGKESRI SVQERQ |
| 428 | OSM_MOV19 _PD1 _sCD28TM_ CD40 | MGVLLTQRTL LSLVLALLFP SMASMQVQLQ QSGAELVKPG ASVKISCKAS GYSFTGYFMN WVKQSHGKSL EWIGRIHPYD GDTFYNQNFK DKATLTVDKS SNTAHMELLS LTSEDFAVYY CTRYDGSRAM DYWGQGTTVT VSSGGGGSGG GGSGGGGSDI ELTQSPASLA VSLGQRAIIS CKASQSVSFA GTSLMHWYHQ |

TABLE 7-continued

Amino Acid Sequences

| ID No | Component | Sequence |
|---|---|---|
| | | KPGQQPKLLI YRASNLEAGV PTRFSGSGSK TDFTLNIHPV EEEDAATYYC<br>QQSREYPYTF GGGTKLEIKA AAGSGGSGRP GWFLDSPDRP WNPPTFSPAL<br>LVVTEGDNAT FTCSFSNTSE SFVLNWYRMS PSNQTDKLAA FPEDRSQPGQ<br>DCRFRVTQLP NGRDFHMSVV RARRNDSGTY LCGAISLAPK AQIKESLRAE<br>LRVTERRAEV PTAHCPSPLF PGPSKPFWVL VVVGGVLACY SLLVTVAFII<br>FWVKKVAKKP TNKAPHPKQE PQEINFPDDL PGSNTAAPVQ ETLHGCQPVT<br>QEDGKESRIS VQERQ |
| 429 | OSM_MOV19<br>_TIGIT<br>_sCD28TM_<br>CD28<br>_CD40 | MGVLLTQRTL LSLVLALLFP SMASMQVQLQ QSGAELVKPG ASVKISCKAS<br>GYSFTGYFMN WVKQSHGKSL EWIGRIHPYD GDTFYNQNFK DKATLTVDKS<br>SNTAHMELLS LTSEDFAVYY CTRYDGSRAM DYWGQGTTVT VSSGGGGSGG<br>GGSGGGGSDI ELTQSPASLA VSLGQRAIIS CKASQSVSFA GTSLMHWYHQ<br>KPGQQPKLLI YRASNLEAGV PTRFSGSGSK TDFTLNIHPV EEEDAATYYC<br>QQSREYPYTF GGGTKLEIKA AAGSGGSGMM TGTIETTGNI SAEKGGSIIL<br>QCHLSSTTAQ VTQVNWEQQD QLLAICNADL GWHISPSFKD RVAPGPGLGL<br>TLQSLTVNDT GEYFCIYHTY PDGTYTGRIF LEVLESSVAE HGARFQIPFW<br>VLVVVGGVLA CYSLLVTVAF IIFWVRSKRS RLLHSDYMNM TPRRPGPTRK<br>HYQPYAPPRD FAAYRSKKVA KKPTNKAPHP KQEPQEINFP DDLPGSNTAA<br>PVQETLHGCQ PVTQEDGKES RISVQERQ |
| 430 | OSM_MOV19<br>_TIGIT<br>_sCD28TM_<br>CD40 | MGVLLTQRTL LSLVLALLFP SMASMQVQLQ QSGAELVKPG ASVKISCKAS<br>GYSFTGYFMN WVKQSHGKSL EWIGRIHPYD GDTFYNQNFK DKATLTVDKS<br>SNTAHMELLS LTSEDFAVYY CTRYDGSRAM DYWGQGTTVT VSSGGGGSGG<br>GGSGGGGSDI ELTQSPASLA VSLGQRAIIS CKASQSVSFA GTSLMHWYHQ<br>KPGQQPKLLI YRASNLEAGV PTRFSGSGSK TDFTLNIHPV EEEDAATYYC<br>QQSREYPYTF GGGTKLEIKA AAGSGGSGMM TGTIETTGNI SAEKGGSIIL<br>QCHLSSTTAQ VTQVNWEQQD QLLAICNADL GWHISPSFKD RVAPGPGLGL<br>TLQSLTVNDT GEYFCIYHTY PDGTYTGRIF LEVLESSVAE HGARFQIPFW<br>VLVVVGGVLA CYSLLVTVAF IIFWVKKVAK KPTNKAPHPK QEPQEINFPD<br>DLPGSNTAAP VQETLHGCQP VTQEDGKESR ISVQERQ |
| 431 | Linker | GGGGSGGGGS GGGGS |
| 432 | Truncated<br>Cyto-<br>plasmic<br>domain<br>CD28<br>Variant | NKILVKQSPM LVAYDNAVNL SCKYSYNLFS REFRASLHKG LDSAVEVCVV<br>YGNYSQQLQV YSKTGFNCDG KLGNESVTFY LQNLYVNQTD IYFCKIEVMY<br>PPPYLDNEKS NGTIIHVKGK HLCPSPLFPG PSKPFWVLVV VGGVLACYSL<br>LVTVAFIIFW VRSKR |
| 433 | CD28.CD13<br>7 fusion | NKILVKQSPM LVAYDNAVNL SCKYSYNLFS REFRASLHKG LDSAVEVCVV<br>YGNYSQQLQV YSKTGFNCDG KLGNESVTFY LQNLYVNQTD IYFCKIEVMY<br>PPPYLDNEKS NGTIIHVKGK HLCPSPLFPG PSKPFWVLVV VGGVLACYSL<br>LVTVAFIIFW VRSKRSRLLH SDYMNMTPRR PGPTRKHYQP YAPPRDFAAY<br>RSRFSVVKRG RKKLLYIFKQ PFMRPVQTTQ EEDGCSCRFP EEEEGGCE |
| 434 | CD28.CD13<br>4 fusion | NKILVKQSPM LVAYDNAVNL SCKYSYNLFS REFRASLHKG LDSAVEVCVV<br>YGNYSQQLQV YSKTGFNCDG KLGNESVTFY LQNLYVNQTD IYFCKIEVMY<br>PPPYLDNEKS NGTIIHVKGK HLCPSPLFPG PSKPFWVLVV VGGVLACYSL<br>LVTVAFIIFW VRSKRSRLLH SDYMNMTPRR PGPTRKHYQP YAPPRDFAAY<br>RSRRDQRLPP DAHKPPGGGS FRTPIQEEQA DAHSTLAKI |
| 435 | CD28.CD2<br>fusion | NKILVKQSPM LVAYDNAVNL SCKYSYNLFS REFRASLHKG LDSAVEVCVV<br>YGNYSQQLQV YSKTGFNCDG KLGNESVTFY LQNLYVNQTD IYFCKIEVMY<br>PPPYLDNEKS NGTIIHVKGK HLCPSPLFPG PSKPFWVLVV VGGVLACYSL<br>LVTVAFIIFW VRSKRSRLLH SDYMNMTPRR PGPTRKHYQP YAPPRDFAAY<br>RSKRKKQRSR RNDEELETRA HRVATEERGR KPHQIPASTP QNPATSQHPP<br>PPPGHRSQAP SHRPPPPGHR VQHQPQKRPP APSGTQVHQQ KGPPLPRPRV<br>QPKPPHGAAE NSLSPSSN |
| 436 | CD28.CD29<br>fusion | NKILVKQSPM LVAYDNAVNL SCKYSYNLFS REFRASLHKG LDSAVEVCVV<br>YGNYSQQLQV YSKTGFNCDG KLGNESVTFY LQNLYVNQTD IYFCKIEVMY<br>PPPYLDNEKS NGTIIHVKGK HLCPSPLFPG PSKPFWVLVV VGGVLACYSL<br>LVTVAFIIFW VRSKRSRLLH SDYMNMTPRR PGPTRKHYQP YAPPRDFAAY<br>RSKLLMIIHD RREFAKFEKE KMNAKWDTGE NPIYKSAVTT VVNPKYEGK |
| 437 | CD28.GITR<br>fusion | NKILVKQSPM LVAYDNAVNL SCKYSYNLFS REFRASLHKG LDSAVEVCVV<br>YGNYSQQLQV YSKTGFNCDG KLGNESVTFY LQNLYVNQTD IYFCKIEVMY<br>PPPYLDNEKS NGTIIHVKGK HLCPSPLFPG PSKPFWVLVV VGGVLACYSL<br>LVTVAFIIFW VRSKRSRLLH SDYMNMTPRR PGPTRKHYQP YAPPRDFAAY<br>RSQLGLHIWQ LRSQCMWPRE TQLLLEVPPS TEDARSCQFP EEERGERSAE<br>EKGRLGDLWV |

TABLE 7-continued

Amino Acid Sequences

| ID No | Component | Sequence |
|---|---|---|
| 438 | CD28.IL2R Y fusion | NKILVKQSPM LVAYDNAVNL SCKYSYNLFS REFRASLHKG LDSAVEVCVV YGNYSQQLQV YSKTGFNCDG KLGNESVTFY LQNLYVNQTD IYFCKIEVMY PPPYLDNEKS NGTIIHVKGK HLCPSPLFPG PSKPFWVLVV VGGVLACYSL LVTVAFIIFW VRSKRSRLLH SDYMNMTPRR PGPTRKHYQP YAPPRDFAAY RSERTMPRIP TLKNLEDLVT EYHGNFSAWS GVSKGLAESL QPDYSERLCL VSEIPPKGGA LGEGPGASPC NQHSPYWAPP CYTLKPET |
| 439 | CD28.CD40 fusion | NKILVKQSPM LVAYDNAVNL SCKYSYNLFS REFRASLHKG LDSAVEVCVV YGNYSQQLQV YSKTGFNCDG KLGNESVTFY LQNLYVNQTD IYFCKIEVMY PPPYLDNEKS NGTIIHVKGK HLCPSPLFPG PSKPFWVLVV VGGVLACYSL LVTVAFIIFW VRSKRSRLLH SDYMNMTPRR PGPTRKHYQP YAPPRDFAAY RSKKVAKKPT NKAPHPKQEP QEINFPDDLP GSNTAAPVQE TLHGCQPVTQ EDGKESRISV QERQ |
| 440 | CD28.CD15 0 fusion | NKILVKQSPM LVAYDNAVNL SCKYSYNLFS REFRASLHKG LDSAVEVCVV YGNYSQQLQV YSKTGFNCDG KLGNESVTFY LQNLYVNQTD IYFCKIEVMY PPPYLDNEKS NGTIIHVKGK HLCPSPLFPG PSKPFWVLVV VGGVLACYSL LVTVAFIIFW VRSKRSRLLH SDYMNMTPRR PGPTRKHYQP YAPPRDFAAY RSRRRGKTNH YQTTVEKKSL TIYAQVQKPG PLQKKLDSFP AQDPCTTIYV AATEPVPESV QETNSITVYA SVTLPES |
| 441 | CD28.CD2. CD40 fusion | NKILVKQSPM LVAYDNAVNL SCKYSYNLFS REFRASLHKG LDSAVEVCVV YGNYSQQLQV YSKTGFNCDG KLGNESVTFY LQNLYVNQTD IYFCKIEVMY PPPYLDNEKS NGTIIHVKGK HLCPSPLFPG PSKPFWVLVV VGGVLACYSL LVTVAFIIFW VRSKRSRLLH SDYMNMTPRR PGPTRKHYQP YAPPRDFAAY RSKRKKQRSR RNDEELETRA HRVATEERGR KPHQIPASTP QNPATSQHPP PPPGHRSQAP SHRPPPPGHR VQHQPQKRPP APSGTQVHQQ KGPPLPRPRV QPKPPHGAAE NSLSPSSNKK VAKKPTNKAP HPKQEPQEIN FPDDLPGSNT AAPVQETLHG CQPVTQEDGK ESRISVQERQ |
| 442 | CD28(IEV) Variant | IEVMYPPPYL DNEKSNGTII HVKGKHLCPS PLFPGPSKPF WVLVVGGVL ACYSLLVTVA FIIFWVRSKR SRLLHSDYMN MTPRRPGPTR KHYQPYAPPR DFAAYRS |
| 443 | SH3 motif2 | PTNKAPHP |
| 444 | SH3 motif3 | PTNKAPH |
| 445 | TRAF2_ motif4 | PKQET |
| 446 | TRAF2_ motif5 | PVQET |
| 447 | TRAF2_ motif6 | SVQET |
| 448 | TRAF6-Motif2 | QEPQEINF |
| 449 | HIS tag | DYKDDDDK |
| 450 | TRAF2/ TRAF3 binding seq source hTNFR2 | PFSKEECAFRS |
| 451 | TRAF2/ TRAF3 binding seq source hCD40 | AAPVQETLHGC |
| 452 | TRAF2/ TRAF3 binding seq source hCD30 | MLSVEEEGKED |

TABLE 7-continued

Amino Acid Sequences

| ID No | Component | Sequence |
|---|---|---|
| 453 | TRAF2/TRAF3 binding seq source hCD27 | TIPIQEDYRKP |
| 454 | TRAF2/TRAF3 binding seq source hLTR | STPHQEDGKAW |
| 455 | TRAF2/TRAF3 binding seq source hATAR | TVAVEETIPST |
| 456 | TRAF2/TRAF3 binding seq source hOX40 | RTPIQEEQADA |
| 457 | TRAF2/TRAF3 binding seq source m41BB | TGAAQEEDACS |
| 458 | TRAF2/TRAF3 binding seq source m41BB | RCPQEEEGGGG |
| 459 | TRAF2/TRAF3 binding seq source h41BB | VQTTQEEDGCS |
| 460 | TRAF2/TRAF3 binding seq source h41BB | RFPEEEEGGCE |
| 461 | TRAF2/TRAF3 binding seq source bLMP1 | RTPVQESGYPD |
| 462 | TRAF2/TRAF3 binding seq source bLMP1 | RPPVQETGGGG |

TABLE 7-continued

Amino Acid Sequences

| ID No | Component | Sequence |
|---|---|---|
| 463 | TRAF2/TRAF3 binding seq source bLMP1 | HPPVQETGGGG |
| 464 | TRAF2/TRAF3 binding seq source bLMP1 | HPPVQETGEGG |
| 465 | TRAF2/TRAF3 binding seq source bLMP1 | HPPIQETGNGG |
| 466 | TRAF2/TRAF3 binding seq source LAT | ALSSQEAEEVE |
| 467 | TRAF2/TRAF3 binding seq source hTANK | SVPIQCTDKTD |
| 468 | TRAF2/TRAF3 binding seq source hLMP1 | PHPQQATDDSS |
| 469 | TRAF2/TRAF3 binding seq source rLMP1 | PYPIQATDGGN |
| 470 | TRAF2/TRAF3 binding seq source rLMP1 | PHPIQATDGAN |
| 471 | TRAF2/TRAF3 binding seq source rLMP1 | PYPVQASDGGD |
| 472 | TRAF2/TRAF3 binding seq source Minor Consensus | P/S/A/TXQ/EE |

TABLE 7-continued

Amino Acid Sequences

| ID No | Component | Sequence |
|---|---|---|
| 473 | TRAF2/TRAF3 binding seq source Major Consensus | PVQE |
| 474 | CD40 TRAF2/TRAF3 variant CD40 WT | KKVAKKPTNKAPHPKQEPQEINFPDDLPGSNTAA--PVQE-- |
| 475 | CD40 TRAF2/TRAF3 variant CD40/v41BB | TLHGCQPVTQEDGKESRI--SVQE--RQ |
| 476 | CD40 TRAF2/TRAF3 variant CD40/vTNFR2 | KKVAKKPTNKAPHPKQEPQEINFPDDLPGSNTAA--TQEE-- |
| 477 | CD40 TRAF2/TRAF3 variant CD40/vATAR | TLHGCQPVTQEDGKESRISVQERQ |
| 478 | CD40 TRAF2/TRAF3 variant CD40/vATAR | KKVAKKPTNKAPHPKQEPQEINFPDDLPGSNTAA--SKEE-- |
| 479 | CD40 TRAF2/TRAF3 variant CD40/v41BB | TLHGCQPVTQEDGKESRISVQERQ |
| 480 | TRAF6 binding seq hCD40 | PQEINF |
| 481 | TRAF6 binding seq hTRANCE-R | PQEIDF |
| 482 | TRAF6 binding seq Mal | PPELRF |
| 483 | TRAF6 binding seq TRIF | PEEMSW |
| 484 | TRAF6 binding seq IRAK (1) | PQENSY |

TABLE 7-continued

Amino Acid Sequences

| ID No | Component | Sequence |
|---|---|---|
| 485 | TRAF6 binding seq IRAK (2) | PVESDE |
| 486 | TRAF6 binding seq IRAK (3) | PEESDE |
| 487 | TRAF6 binding seq IRAK-2 (1) | PEETDE |
| 488 | TRAF6 binding seq IRAK-2 (2) | PTENGE |
| 489 | TRAF6 binding seq IRAK-M | PVEDDE |
| 490 | TRAF6 binding seq RIP2 | PPENYE |
| 491 | TRAF6 binding seq MyD88 | PSELRF |
| 492 | TRAF6 binding seq Consensus | PXEXXAc/Ar |
| 493 | CD40 TRAF6 variants CD40 WT | KKVAKKPTNKAPHPKQE--PQEINF--PDDLPGSNTAAPVQE |
| 494 | CD40 TRAF6 variants CD40/vTRIF | TLHGCQPVTQEDGKESRISVQERQ |
| 495 | CD40 TRAF6 variants CD40/vRIP2 | KKVAKKPTNKAPHPKQE--PEEMSW--PDDLPGSNTAAPVQE |
| 496 | CD40 TRAF6 variants CD40/vIRAK(1) | TLHGCQPVTQEDGKESRISVQERQ |
| 497 | CD40 TRAF2/TRAF3/TRAF6 consensus variants CD40 WT | KKVAKKPTNKAPHPKQE--PQEINF--PDDLPGSNTAA--PVQE-- |

TABLE 7-continued

Amino Acid Sequences

| ID No | Component | Sequence |
|---|---|---|
| 498 | CD40 TRAF2/ TRAF3/ TRAF6 consensus variants | TLHGCQPVTQEDGKESRI--SVQE--RQ |
| 499 | CD40 TRAF2/ TRAF3/ TRAF6 consensus variants | KKVAKKPTNKAPHPKQE--PXEXX(Ac/Ar)-- PDDLPGSNTAAPVQETLHGCQPVTQEDGKESRISVQERQ |
| 500 | CD40 TRAF2/ TRAF3/ TRAF6 consensus variants | KKVAKKPTNKAPHPKQEPQEINFPDDLPGSNTAA--(P/S/A/T)X(Q/E)E-- TLHGCQPVTQEDGKESRISVQERQ |
| 501 | CD40 TRAF2/ TRAF3/ TRAF6 consensus variants | KKVAKKPTNKAPHPKQEPQEINFPDDLPGSNTAAPVQE |
| 502 | CD40 TRAF2/ TRAF3/ TRAF6 consensus variants | TLHGCQPVTQEDGKESRI--(P/S/A/T)X(Q/E)E-RQ |
| 503 | CD40 TRAF2/ TRAF3/ TRAF6 consensus variants | KKVAKKPTNKAPHPKQE--PXEXX(Ac/Ar)--PDDLPGSNTAA-- (P/S/A/T)X(Q/E)-ETLHGCQPVTQEDGKESRISVQERQ |
| 504 | CD40 TRAF2/ TRAF3/ TRAF6 consensus variants | KKVAKKPTNKAPHPKQEPQEINFPDDLPGSNTAA--(P/S/A/T)X(Q/E)E-- TLHGCQPVTQEDGKESRI--(P/S/A/T)X(Q/E)E-RQ |
| 505 | CD40 TRAF2/ TRAF3/ TRAF6 consensus variants | KKVAKKPTNKAPHPKQE--PXEXX(Ac/Ar)--PDDLPGSNTAAPVQE |
| 506 | CD28(IEV) Variant | NKILVKQSPM LVAYDNAVNL SCKYSYNLFS REFRASLHKG LDSAVEVCW YGNYSQQLQV YSKTGFNCDG KLGNESVTFY LQNLYVNQTD IYFCKIEV |
| 507 | SP-TGIT | MRWCLLLIWA QGLRQAPLAS G |
| 508 | SS1 | QVQLQQSGPE LEKPGASVKL SCKASGYSFT GYTMNWVKQS HGKSLEWIGL ITPYNGASSY NQKFRGKATL TVDKSSSTAY MDLLSLTSED SAVYFCARGG YDGRGFDYWG QGTTVTVSSG GGGSGGGGSG GGGSDIELTQ SPAIMSASPG EKVTMTCSAS SSVSYMHWYQ QKSGTSPKRW IYDTSKLASG VPGRFSGSGS GNSYSLTISS VEAEDDATYY CQQWSKHPLT FGAGTKLEIK |
| 509 | M5 (humanised SS1) | QVQLVQSGAE VEKPGASVKV SCKASGYTFT DYYMHWVRQA PGQGLEWMGW INPNSGGTNY AQKFQGRVTM TRDTSISTAY MELSRLRSDD TAVYYCASGW DFDYWGQGTL VTVSSGGGGS GGGGSGGGGS DIVMTQSPSS LSASVGDRVT ITCRASQSIR YYLSWYQQKP GKAPKLLIYT ASILQNGVPS RFSGSGSGTD FTLTISSLQP EDFATYYCLQ TYTTPDFGPG TKVEIK |

TABLE 7-continued

Amino Acid Sequences

| ID No | Component | Sequence |
|---|---|---|
| 510 | HN1 | QVQLVQSGAE VKRPGASVQV SCRASGYSIN TYYMQWVRQA PGAGLEWMGV INPSGVTSYA QKFQGRVTLT NDTSTNTVYM QLNSLTSADT AVYYCARWAL WGDFGMDVWG KGTLVTVSSG GGGSGGGGSG GGGSDIQMTQ SPSTLSASIG DRVTITCRAS EGIYHWLAWY QQKPGKAPKL LIYKASSLAS GAPSRFSGSG SGTDFTLTIS SLQPDDFATY YCQQYSNYPL TFGGGTKLEI K |
| 511 | M912 | QVQLQESGPG LVKPSETLSL TCTVSGGSVS SGSYYWSWIR QPPGKGLEWI GYIYYSGSTN YNPSLKSRVT ISVDTSKNQF SLKLSSVTAA DTAVYYCARE GKNGAFDIWG QGTMVTVSSG GGGSGGGGSG GGGSDIQMTQ SPSSLSASVG DRVTITCRAS QSISSYLNWY QQKPGKAPKL LIYAASSLQS GVPSGFSGSG SGTDFTLTIS SLQPEDFATY YCQQSYSTPL TFGGGTKVEI K |
| 512 | HuYP218 | EVQLVESGGG LVQPGGSLRL SCAASGFDLG FYFYACWVRQ APGKGLEWVS CIYTAGSGST YYASWAKGRF TISRDNSKNT LYLQMNSLRA EDTAVYYCAR STANTRSTYY LNLWGQGTLV TVSSGGGGSG GGGSGGGGSD IQMTQSPSSL SASVGDRVTI TCQASQRISS YLSWYQQKPG KVPKLLIYGA STLASGVPSR FSGSGSGTDF TLTISSLQPE DVATYYCQSY AYFDSNNWHA FGGGTKVEI |
| 513 | P4 | QVQLQQSGPG LVTPSQTLSL TCAISGDSVS SNSATWNWIR QSPSRGLEWL GRTYYRSKWY NDYAVSVKSR MSINPDTSKN QFSLQLNSVT PEDTAVYYCA RGMMTYYYGM DVWGQGTTVT VSSGGGGSGG GGSGGGGSQP VLTQSSSLSA SPGASASLTC TLRSGINVGP YRIYWYQQKP GSPPQYLLNY KSDSDKQQGS GVPSRFSGSK DASANAGVLL ISGLRSEDEA DYYCMIWHSS AAVFGGGTQL TVLS |
| 514 | OSM_MFE23 _spCD8_ CD28_CD40 | MGVLLTQRTL LSLVLALLFP SMASMQVLQ QSGAELVRSG TSVKLSCTAS GFNIKDSYMH WLRQGPEQGL EWIGWIDPEN GDTEYAPKFQ GKATFTTDTS SNTAYLQLSS LTSEDTAVYY CNEGTPTGPY YFDYWGQGTT VTVSSGGGGS GGGGSGGGGS ENVLTQSPAI MSASPGEKVT ITCSASSSVS YMHWFQQKPG TSPKLWIYST SNLASGVPAR FSGSGSGTSY SLTISRMEAE DAATYYCQQR SSYPLTFGAG TKLELKRAAA GSGGSGFVPV FLPAKPTTTP APRPPTPAPT IASQPLSLRP EACRPAAGGA VHTRGLDFAC DIYIWAPLAG TCGVLLLSLV ITLYCNHRNR SKRSRLLHSD YMNMTPRRPG PTRKHYQPYA PPRDFAAYRS KKVAKKPTNK APHPKQEPQE INFPDDLPGS NTAAPVQETL HGCQPVTQED GKESRISVQE RQ |
| 515 | Human ICO S_Q9Y6W8 | GEINGSANYE MFIFHNGGVQ ILCKYPDIVQ QFKMQLLKGG QILCDLTKTK GSGNTVSIKS LKFCHSQLSN NSVSFFLYNL DHSHANYYFC NLSIFDPPPF KVTLTGGYLH IYESQLCCQL KFWLPIGCAA FVVVCILGCI LICWLTKKKY SSSVHDPNGE YMFMRAVNTA KKSRLTDVTL |
| 516 | CD40 TRAF2 motif1 | PKQE |
| 517 | CD40 TRAF2 motif2 | PVQE |
| 518 | CD40 TRAF2 motif3 | SVQE |
| 519 | CD40 TRAF6 motif | QEPQEINFP |
| 520 | CD40 PKA motif1 | KKPTNKA |
| 521 | CD40 PKA motif2 | SRISVQE |
| 522 | CD28 EC | ILVKQSPMLV AYDNAVNLSC KYSYNLFSRE FRASLHKGLD SAVEVCVVYG NYSQQLQVYS KTGFNCDGKL GNESVTFYLQ NLYVNQTDIY FCKIEVMYPP PYLDNEKSNG TIIHVKGKHL CPSPLFPGPS KP |

Ar = aromatic residue; Ac = acidic residue; X = any amino acid

Although the present invention and its advantages have been described in detail, it should be understood that various changes, substitutions and alterations can be made herein without departing from the spirit and scope of the invention as defined in the appended claims.

Various embodiments are also contemplated in the following numbered arrangements:

1. A chimeric costimulatory antigen receptor (CoStAR) which comprises:
   an extracellular binding domain that binds to carcinoembryonic antigen (CEA), or an extracellular binding domain that binds to mesothelin (MSLN), operatively linked to a transmembrane domain, and
   a first signaling domain and an intracellular domain of ICOS or a signaling fragment thereof, or
   a first signaling domain and an intracellular domain of NTRK1 or a signaling fragment thereof, or
   a first signaling domain and an intracellular domain of DAP10 or a signaling fragment thereof, or
   a first signaling domain and a CD40 signaling domain or a signaling fragment thereof, or
   a first signaling domain and one or more of a TRAF2/TRAF3 sequence, a TRAF6 sequence, a TRAF2 sequence, or an IProx sequence.
2. The CoStAR of arrangement 1, wherein the first signaling domain comprises a signaling domain or signaling fragment of CD2, CD9, CD26, CD27, CD28, CD29, CD38, CD40, CD43, CD46, CD49d, CD55, CD73, CD81, CD82, CD99, CD100, CD134 (OX40), CD137 (41BB), CD150 (SLAM), CD270 (HVEM), CD278 (ICOS), CD357 (GITR), or EphB6.
3. The CoStAR of arrangement 1, wherein the CoStAR comprises a second signaling domain.
4. The CoStAR of arrangement 3, wherein the second signaling domain comprises a signaling domain or signaling fragment of CD2, CD9, CD26, CD27, CD28, CD29, CD38, CD40, CD43, CD46, CD49d, CD55, CD73, CD81, CD82, CD99, CD100, CD134 (OX40), CD137 (41BB), CD150 (SLAM), CD270 (HVEM), CD278 (ICOS), CD357 (GITR), or EphB6.
5. The CoStAR of arrangement 1, wherein the CD40 signaling fragment comprises an SH3 motif (KPTNKAPH, SEQ ID NO:35), TRAF2 motif (PKQE, SEQ ID NO:36, PVQE, SEQ ID NO:37, SVQE, SEQ ID NO:38), TRAF6 motif (QEPQEINFP, SEQ ID NO:39), PKA motif (KKPTNKA, SEQ ID NO:40, SRISVQE, SEQ ID NO:41), or a combination thereof, or is a full length CD40 intracellular domain.
6. The CoStAR of arrangement 2, wherein the first signaling domain comprises a full length costimulatory domain.
7. The CoStAR of arrangement 1, wherein the extracellular binding domain is operatively linked to the transmembrane domain by a linker and/or a spacer.
8. The CoStAR of arrangement 7, wherein the linker comprises from about 5 to about 20 amino acids.
9. The CoStAR of arrangement 7, wherein the linker or spacer comprises from about 10 to about 250 amino acids.
10. The CoStAR of arrangement 1, wherein the CoStAR comprises a second extracellular binding domain.
11. The CoStAR of arrangement 10, wherein the second extracellular binding domain comprises a ligand binding domain from CD8, CD28, or ICOS.
12. The CoStAR of arrangement 1, wherein the transmembrane domain comprises a transmembrane domain from CD28, CD8, ICOS, DAP10, or NTRK.
13. The CoStAR of arrangement 1, wherein the transmembrane domain comprises the transmembrane domain sequence of SEQ ID NO:20, SEQ ID NO:21, or SEQ ID NO:22.
14. The CoStAR of arrangement 1, wherein the extracellular binding domain comprises an scFv, a peptide, an antibody heavy-chain variable domain, an antibody light-chain variable domain, or a CEA ligand or a MSLN ligand.
15. The CoStAR of any one of arrangements 1 to 14, which further comprises a CD3 signaling domain at the C-terminus.
16. The CoStAR of any one of arrangements 1 to 14, which further comprises an N-terminal signal peptide.
17. The CoStAR of arrangement 16, wherein the N-terminal signal peptide comprises the signal peptide of oncostatin M (OSM), CD8α, CD2, interleukin-2 (IL-2), granulocyte-macrophage colony stimulating factor (GM-CSF), or human IgGK.
18. A nucleic acid which encodes the CoStAR of any one of arrangements 1 to 17.
19. A vector which comprises the nucleic acid of arrangement 18.
20. A cell which expresses the CoStAR of any one of arrangements 1 to 16.
21. The cell of arrangement 20, wherein the cell comprises an alpha-beta T cell, gamma-delta T cell, T regulatory cell, TIL, NKT cell or NK cell.
22. The cell of arrangement 20, wherein the cell coexpresses a CAR or a TCR.
23. A method of making the cell of arrangement 20, which comprises the step of transducing or transfecting a cell with a vector of arrangement 19.
24. A method for preparing a population of cells that express a CoStAR of any one of arrangements 1 to 16, which comprises
   i) detecting expression of the CoStAR on the surface of cells transfected or transduced with a vector of arrangement 19; and
   ii) selecting cells which are identified as expressing the CoStAR.
25. A cell population which is enriched for cell expression a CoStAR of any one of arrangements 1 to 16.
26. A method for treating a disease in a subject, which comprises the step of administering a cell according to any of arrangements 20 to 22, or a cell population according to arrangement 25 to the subject.

In some embodiments, CoStAR function can be evaluated by co-incubation with cells expressing the target antigen of the CoStAR scFv. In some embodiments, the cells used the evaluate the CoStAR functioning are Ovcar3 cells. In some embodiments, the cells used to evaluate the CoStar functioning are Ovcar-OKT-3 cells. In some embodiments, MSLN expressed on the Ovcar3 cells provides signal 2 to the CoStAR expressing cell. In some embodiments, OKT-3 expressed on the Ovcar3 cells provides signal 1 to the CoStAR expressing cell. In some embodiments, both signal 1 and signal 2 are provided to the CoStAR expressing cells from the Ovcar-OKT3 cells. In some embodiments the target cells are K562 cells. In some embodiments, OKT-3 expressed on the K562 cells provides signal 1 to the CoStAR expressing cell. In some embodiments, both signal 1 and signal 2 are provided to the CoStAR expressing cells from the K562-OKT3-CEACAM5 cells.

In some embodiments, CoStAR transduced cells exhibit higher fold expansion than nontransduced T cells exposure to signal 1 and signal 2. In some embodiments, CoStAR transduced cells continue to exhibit enhanced expansion after serial restimulation with target cells. In some embodiments, this enhanced expansion can be stimulated for 1 week, for 2 weeks, for 3 weeks, for 4 weeks, for 5 weeks, or for 6 weeks post transduction with the CoStAR construct. In some embodiments, the target cells are K562-OKT3-CEACAM5 cells.

In some embodiments, a high level of cells positive for CoStAR expression are detected days after transduction. In some embodiments a high level of cells positive for CoStAR expression are detected 1 day after transduction, 2 days after transduction, 3 days after transduction, 4 days after transduction, 5 days after transduction, 6 days after transduction, 1 week after transduction, 2 weeks after transduction, 3 weeks after transduction, or 4 weeks after transduction. In some embodiments the percentage of cells positive for CoStAR expression is 20%, 25%, 30%, 35%, 40%, 45%, 50%, 55%, 60%, 65%, 70%, 75%, 80%, 85%, 95%, or greater than 95%.

Various embodiments are also contemplated in the following numbered arrangements:

1. A chimeric costimulatory antigen receptor (CoStAR) which comprises:
    an extracellular binding domain that binds to carcinoembryonic antigen (CEA), or an extracellular binding domain that binds to mesothelin (MSLN), operatively linked to a transmembrane domain, and
    a first signaling domain and an intracellular domain of ICOS or a signaling fragment thereof, or
    a first signaling domain and an intracellular domain of NTRK1 or a signaling fragment thereof, or
    a first signaling domain and an intracellular domain of DAP10 or a signaling fragment thereof, or
    a first signaling domain and a CD40 signaling domain or a signaling fragment thereof, or
    a first signaling domain and one or more of a TRAF2/TRAF3 sequence, a TRAF6 sequence, a TRAF2 sequence, or an IProx sequence.
2. The CoStAR of arrangement 1, wherein the first signaling domain comprises a signaling domain or signaling fragment of CD2, CD9, CD26, CD27, CD28, CD29, CD38, CD40, CD43, CD46, CD49d, CD55, CD73, CD81, CD82, CD99, CD100, CD134 (OX40), CD137 (41BB), CD150 (SLAM), CD270 (HVEM), CD278 (ICOS), CD357 (GITR), or EphB6.
3. The CoStAR of arrangement 1, wherein the CoStAR comprises a second signaling domain.
4. The CoStAR of arrangement 3, wherein the second signaling domain comprises a signaling domain or signaling fragment of CD2, CD9, CD26, CD27, CD28, CD29, CD38, CD40, CD43, CD46, CD49d, CD55, CD73, CD81, CD82, CD99, CD100, CD134 (OX40), CD137 (41BB), CD150 (SLAM), CD270 (HVEM), CD278 (ICOS), CD357 (GITR), or EphB6.
5. The CoStAR of arrangement 1, wherein the CD40 signaling fragment comprises an SH3 motif (KPTNKAPH, SEQ ID NO:35), TRAF2 motif (PKQE, SEQ ID NO:36, PVQE, SEQ ID NO:37, SVQE, SEQ ID NO:38), TRAF6 motif (QEPQEINFP, SEQ ID NO:39), PKA motif (KKPTNKA, SEQ ID NO:40, SRISVQE, SEQ ID NO:41), or a combination thereof, or is a full length CD40 intracellular domain.
6. The CoStAR of arrangement 2, wherein the first signaling domain comprises a full length costimulatory domain.
7. The CoStAR of arrangement 1, wherein the extracellular binding domain is operatively linked to the transmembrane domain by a linker and/or a spacer.
8. The CoStAR of arrangement 7, wherein the linker comprises from about 5 to about 20 amino acids.
9. The CoStAR of arrangement 7, wherein the linker or spacer comprises from about 10 to about 250 amino acids.
10. The CoStAR of arrangement 1, wherein the CoStAR comprises a second extracellular binding domain.
11. The CoStAR of arrangement 10, wherein the second extracellular binding domain comprises a ligand binding domain from CD8, CD28, or ICOS.
12. The CoStAR of arrangement 1, wherein the transmembrane domain comprises a transmembrane domain from CD28, CD8, ICOS, DAP10, or NTRK.
13. The CoStAR of arrangement 1, wherein the transmembrane domain comprises the transmembrane domain sequence of SEQ ID NO:20, SEQ ID NO:21, or SEQ ID NO:22.
14. The CoStAR of arrangement 1, wherein the extracellular binding domain comprises an scFv, a peptide, an antibody heavy-chain variable domain, an antibody light-chain variable domain, or a CEA ligand or a MSLN ligand.
15. The CoStAR of any one of arrangements 1 to 14, which further comprises a signaling domain at the C-terminus.
16. The CoStAR of any one of arrangements 1 to 14, which further comprises an N-terminal signal peptide.
17. The CoStAR of arrangement 16, wherein the N-terminal signal peptide comprises the signal peptide of oncostatin M (OSM), CD8α, CD2, interleukin-2 (IL-2), granulocyte-macrophage colony stimulating factor (GM-CSF), or human IgGκ.
18. A nucleic acid which encodes the CoStAR of any one of arrangements 1 to 17.
19. A vector which comprises the nucleic acid of arrangement 18.
20. A cell which expresses the CoStAR of any one of arrangements 1 to 16.
21. The cell of arrangement 20, wherein the cell comprises an alpha-beta T cell, gamma-delta T cell, T regulatory cell, TIL, NKT cell or NK cell.
22. The cell of arrangement 20, wherein the cell coexpresses a CAR or a TCR.
23. A method of making the cell of arrangement 20, which comprises the step of transducing or transfecting a cell with a vector of arrangement 19.
24. A method for preparing a population of cells that express a CoStAR of any one of arrangements 1 to 16, which comprises
i) detecting expression of the CoStAR on the surface of cells transfected or transduced with a vector of arrangement 19; and
ii) selecting cells which are identified as expressing the CoStAR.
25. A cell population which is enriched for cell expression a CoStAR of any one of arrangements 1 to 16.
26. A method for treating a disease in a subject, which comprises the step of administering a cell according to any of arrangements 20 to 22, or a cell population according to arrangement 25 to the subject.
27. A fusion protein, wherein the fusion protein comprises:
    a binding domain specific for CEA linked to;
    a transmembrane domain that is linked to;
    an ICOS domain that is linked to;
    a CD40 signaling domain.

28. A fusion protein, wherein the fusion protein comprises:
a binding domain specific for MSLN linked to;
a transmembrane domain that is linked to;
a CD28 domain that is linked to;
a CD40 signaling domain.

29. A fusion protein, wherein the fusion protein comprises:
a first sequence that is at least 70% identical to SEQ ID NO: 12;
a second sequence that is a transmembrane domain;
a third sequence that is at least 70% identical to SEQ ID NO: 518; and
a fourth sequence that is at least 70% identical to SEQ ID NO: 32.

30. A fusion protein, wherein the fusion protein comprises:
a first sequence that is at least 70% identical to any one of SEQ ID NO: 186-191;
a second sequence that is a transmembrane domain;
a third sequence that is at least 70% identical to SEQ ID NO: 25; and
a fourth sequence that is at least 70% identical to SEQ ID NO: 32

31. A fusion protein, wherein the fusion protein comprises:
a HCDR1 that is an HCDR1 in SEQ ID NO: 12;
a HCDR2 that is an HCDR2 in SEQ ID NO: 12;
a HCDR3 that is an HCDR3 in SEQ ID NO: 12;
a LCDR1 that is an LCDR1 in SEQ ID NO: 12;
a LCDR2 that is an LCDR2 in SEQ ID NO: 12;
a LCDR3 that is an HCDR3 in SEQ ID NO: 12,
wherein 1, 2, 3, 4, 5, or 6 of the LCDRs can include 1, 2, or 3 point mutations;
a second sequence that is a transmembrane domain;
a third sequence that is at least 70% identical to SEQ ID NO: 515; and
a fourth sequence that is at least 70% identical to SEQ ID NO: 32.

32. The fusion protein of arrangement 31, wherein the fusion protein further comprises a signal peptide sequence that is at least 70% identical to SEQ ID NO: 1.

33. The fusion protein of arrangement 31, wherein the fusion protein further comprises a linker sequence that is at least 70% identical to SEQ ID NO: 18.

34. The fusion protein of arrangement 31, wherein the fusion protein further comprises an ICOS sequence that is at least 70% identical to SEQ ID NO: 515.

35. The fusion protein of arrangement 31, wherein the fusion protein further comprises an CD40 sequence that is at least 70% identical to SEQ ID NO: 32.

36. A fusion protein, wherein the fusion protein comprises:
a HCDR1 that is an HCDR1 in SEQ ID NOs: 186-191;
a HCDR2 that is an HCDR2 in SEQ ID NOs: 186-191;
a HCDR3 that is an HCDR3 in SEQ ID NOs: 186-191;
a LCDR1 that is an LCDR1 in SEQ ID NOs: 186-191;
a LCDR2 that is an LCDR2 in SEQ ID NOs: 186-191;
a LCDR3 that is an HCDR3 in SEQ ID NOs: 186-191
wherein 1, 2, 3, 4, 5, or 6 of the LCDRs can include 1, 2, or 3 point mutations;
a second sequence that is a transmembrane domain;
a third sequence that is at least 70% identical to SEQ ID NO: 25; and
a fourth sequence that is at least 70% identical to SEQ ID NO: 32

37. The fusion protein of arrangement 36, wherein the fusion protein further comprises a signal peptide sequence that is at least 70% identical to SEQ ID NO: 1.

38. The fusion protein of arrangement 36, wherein the fusion protein further comprises a linker sequence that is at least 70% identical to SEQ ID NO: 18.

39. The fusion protein of arrangement 36, wherein the fusion protein further comprises an CD28 TM sequence that is at least 70% identical to SEQ ID NO: 19.

40. The fusion protein of arrangement 36, wherein the fusion protein further comprises an CD28 sequence that is at least 70% identical to SEQ ID NO: 25.

41. The fusion protein of arrangement 36, wherein the fusion protein further comprises an CD40 sequence that is at least 70% identical to SEQ ID NO: 32.

42. A method of cell therapy comprising:
a) identifying a subject, wherein the subject has cancer that expresses MSLN or CEA; and
b) administering any one or more of the CoSTaRs or fusion proteins in any one of the preceding arrangements.

43. A method of treating a cancer in a subject that expresses MSLN or CEA, the method comprising:
a) identifying a subject, wherein the subject has cancer that expresses MSLN or CEA; and
b) administering any one or more of the CoSTaRs or fusion proteins in any one of the preceding arrangements.

The present invention will be further illustrated in the following Examples which are given for illustration purposes only and are not intended to limit the invention in any way.

EXAMPLES

Example 1—Production of T-Cells Expressing CoStAR

Materials and Methods

Construct design—The MFE23 CoStAR consists of an MFE23 derived single chain antibody fragment nucleotide sequence with an oncostatin M1 leader sequence fused to the entire human CD28 nucleic acid sequence. The CoStAR nucleotide sequence was codon optimised and gene synthesised by Genewiz Inc. The constructs were cloned into pSF.Lenti (Oxford Genetics) via an XbaI and NheI site.

Construct design—The MFE23 CoStAR consists of a CEA-specific MFE23, humanised (hu) MFE23, CEA6, BW431/26 or huT84.66 derived single chain antibody fragment nucleotide sequence with an oncostatin M1, CD8α, CD2, IL-2, GM-CSF or hIgGκ VIII leader sequence. Each CoStAR has an an extracellular spacer domain derived from CD8 or CD28 or truncated CD28 and a signalling domain derived from CD28 and CD40. The constructs were cloned into pSF.Lenti (Oxford Genetics) containing an MND promoter, and separated from a truncated CD34 marker gene via a P2A cleavage sequence.

Lentiviral Production—Lentiviral production was performed using a three-plasmid packaging system (Cell Biolabs, San Diego, USA) by mixing 10 μg of each plasmid, plus 10 μg of the pSF.Lenti lentiviral plasmid containing the transgene, together in serum free RPMI containing 50 mM $CaCl_2$). The mixture was added dropwise to a 50% confluent monolayer of 293T cells in 75 $cm^2$ flasks. The viral supernatants were collected at 48 and 72 h post transfection, pooled and concentrated using LentiPac lentiviral supernatant concentration (GeneCopoeia, Rockville, Maryland, USA) solution according to the manufacturer's instructions. Lentiviral supernatants were concentrated 10-fold and used to directly infect primary human T-cells in the presence of 4 polybrene (Sigma-Aldrich, Dorset, UK). Peripheral blood mononuclear cells were isolated from normal healthy donors before activation for 24 hours with T-cell activation and expansion beads (Invitrogen) according to the manufacturer's instructions before addition of lentiviral supernatants.

Cell transduction was assessed 96 hours post infection using CEA.hFc protein and anti-hFc-PE secondary, plus anti-CD34-APC or by anti-CD34-PE antibodies alone. Cells were then expanded further using ×10 donor mismatched irradiated PBMC feeders at a 1:20-1:200 ratio in RPMI+ 10% FCS with the addition of 1 µg/ml PHA and 200 IU/ml IL-2. After 14 days the cells were stained as previous and stored ready for assay.

Functionality assays were performed by mixing CoStAR positive or negative cells with wild-type or OKT3 engineered CEA-Positive LoVo or LS174T cells. Briefly, T-cells were mixed with LoVo cells at varying ratios in 96-well plates and IFNγ or IL-2 measured by ELISA. The remaining cells were incubated with 1:10 dilution of WST-1 reagent (Sigma, UK) for 30 min before absorbance reading at 450 nm. % Cytotoxicity was determined using the following equation=100−((Experimental reading−T-cells alone)/(tumour alone))×100.

Proliferation assays were performed by first loading T-cells with 10 µM eFluor450 proliferation dye (eBioscience, UK) for 10 min at 37° C. at a concentration of $1\times10^7$ cells/ml before incubating the cells in 5 volumes of cold T-cell media for 5 min on ice. Cells were then washed excessively to remove unbound dye and added to cocultures containing tumour cells. Cells were removed at 2, 6 and 10 days, 1:200 dilution of DRAQ7 added and the cells analysed using a MACSQuant cytometer and MACSQuantify software.

Cell counts for proliferation assays were performed by taking cells from the wells and staining with anti-CD2 PerCP eFluor710 antibody (eBioscience, UK) for 20 min in the dark, followed by DRAQ7 staining and counts made using a MACSQuant analyser.

Results

Primary human T-cells were isolated from Buffy coats obtained from the NHSBT. T-cells were isolated by Ficoll-mediated isolation and T-cell negative isolation kits (StemCell Technologies). The isolated T-cells were activated with human T-cell activation and expansion beads (Invitrogen, UK). Cells were incubated with concentrated lentiviral particles and expanded over a number of days. The lentivirus contained the DNA sequence of the MFE.CoStAR.2A.tCD34 construct (MFE23.scFv fused to full length human CD28 co-expressed with truncated human CD34 via a 2A cleavage sequence). Successfully transduced cells were further expanded using irradiated feeders as outlined in materials and methods. Donor 1 transduction was measured at 22.69% (17.15 CD34+/CoStAR+ plus 5.53% CD34−/CoStAR+), donor 2 was measured at 20.73%, and donor 3 at 13.34%. Cells were enriched for CoStAR expression using anti-CD34 antibodies to obtain T-cell populations greater than 90% CoStAR positive.

To generate a physiologically relevant in vitro model to test the impact of CoStAR on T-cell activity, the non-transduced and transduced cells were tested against the CEA+tumour cell lines LoVo and LS174T. To enable activation of the T-cells in response to the unmatched tumour lines we engineered the tumour cells to express an anti-CD3 single chain antibody fragment anchored to the cell membrane by way of a synthetic transmembrane domain and split from the GFP marker gene using an IRES element to visualise transduced cells using flow cytometry.

Figures 3A, 3B, 3C, 3D, 3E:
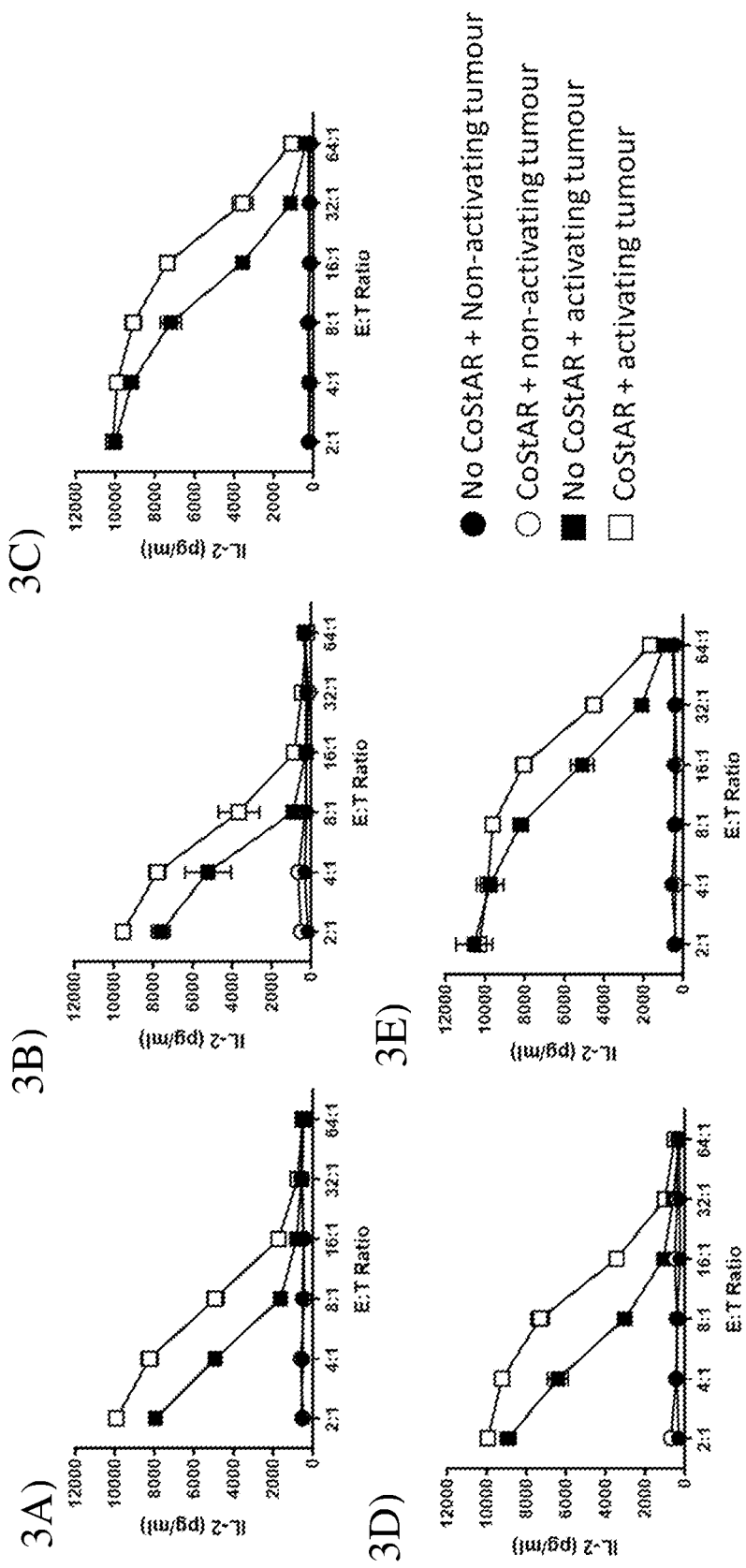
FIG. 3A-3E—Functional activity of CoStAR in T-cells in response to LS174T and LoVo tumour presented antigen. Normal donor T-cell populations from donor 1 (3A &3 D), donor 2 (3B) and donor 3 (3C & 3E) were lentivirally engineered to express a CoStAR which targets carcinoembryonic antigen and magnetically sorted to enrich for the transgene using CD34 magnetic selection. T-cells were mixed with wild-type un-engineered CEA+tumour cells (Non-activating tumour) or CEA+tumour cells engineered to express a cell surface anchored anti-CD3 single chain antibody fragment (Activating tumour) at the indicated effector to target ratios and IL-2 measured in the supernatant by ELISA. Data obtained using LS174T cells (3A, 3B & 3C) and LoVo (3D & 3E).

Single cell clones of LoVo and LS174T were generated from bulk transfectants. Non-transduced and CoStAR transduced T-cells were mixed at varying effector:target ratios with wild-type non-transduced or OKT3-engineered LS174T or LoVo cells. After 24 hours coculture media was taken for IL-2 ELISA measurement. Activation dependent IL-2 secretion was observed from both CoStAR+ and CoStAR− T-cell populations from three donors in response to OKT3 engineered LS174T cells with only background IL-2 secretion seen from transduced and non-transduced T-cells in response to un-engineered tumour cells (FIG. 3A-C). CoStAR enhanced IL-2 secretion towards OKT3 engineered tumour cells was found in all three donors tested. The effect was most evident at E:T ratios of 8:1 and 16:1 and at higher E:T ratios IL-2 secretion was too low to measure accurately. At lower effector to target ratios it appeared that IL-2 secretion was saturating from non-transduced cells. These observations were repeated in LoVo cells with two of the three donors tested against LS174T with similar results (FIGS. 3D & E).

Figures 4A, 4B, 4C, 4D:
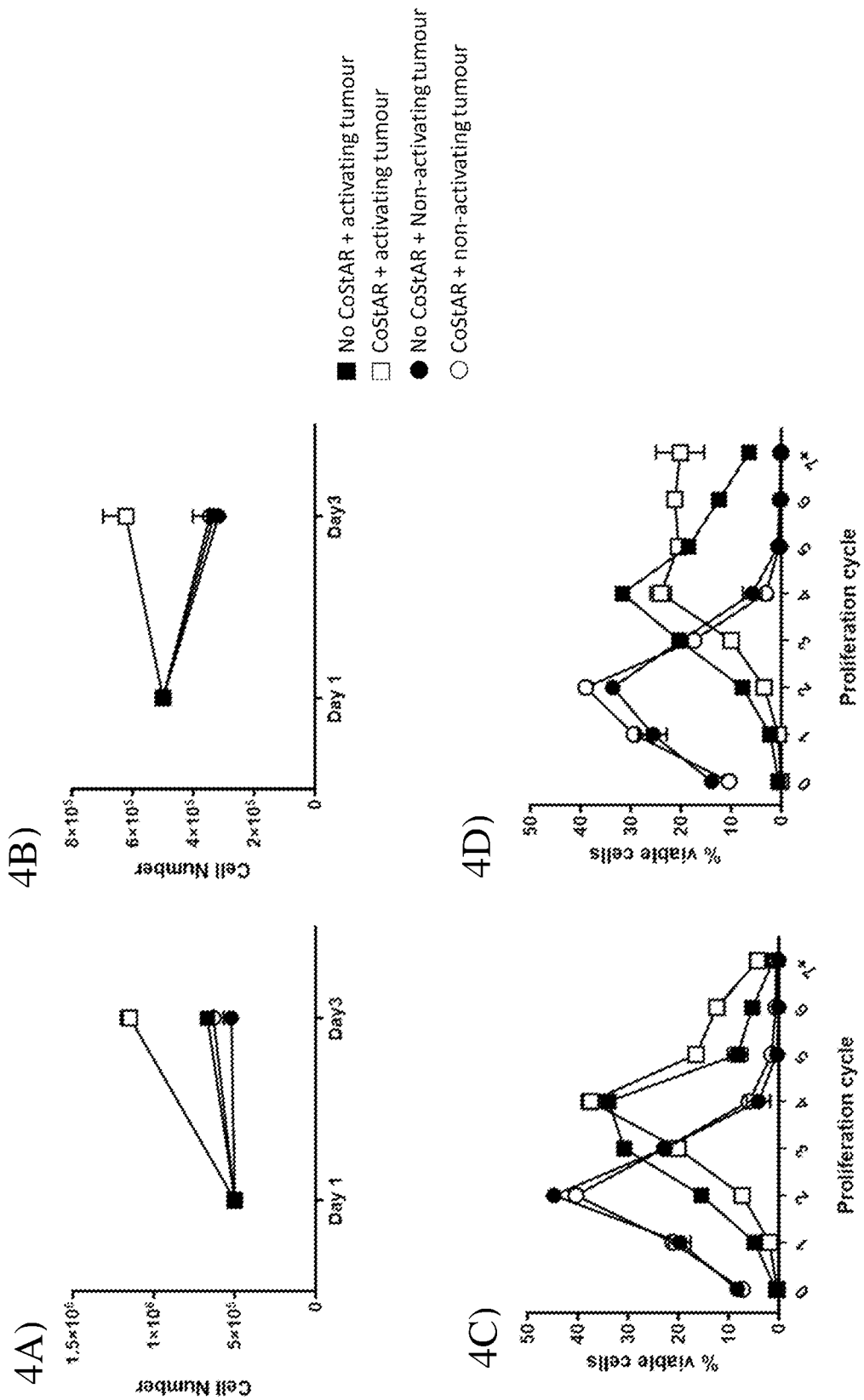
FIG. 4A-4D—Effect of CoStAR on T-cell proliferation. $5 \times 10^5$ transduced and non transduced T-cells were mixed with $6.25 \times 10^3$ or $6.25 \times 10^4$ wild-type LoVo or LoVo-OKT3 cells in the presence (4A) or absence (4B) of IL-2 and cell counts made after three days. In another assay under the same cell ratios T-cells from two donors (4C and 4D) were loaded with proliferation dye and the number of proliferation cycles the cells had gone through determined by dye dilution after six days using flow cytometry.

To determine the impact of CoStAR on T-cell expansion, transduced or non-transduced T-cells were mixed with wild-type or OKT3-GFP engineered LoVo cells the number of total cells after 3 days was counted. CoStAR enhanced survival and/or proliferation of engineered T-cells in response to LoVo-OKT3 but not wild-type LoVo cells in the presence of IL-2 (FIG. 4A) and absence of IL-2 (FIG. 4B). To further investigate this phenomenon, cell proliferation analysis was performed in T-cells from two donors using proliferation dye to count the number of cell cycles each population went through over 6 days (FIGS. 4C & D). A larger proportion of CoStAR engineered cells went through 5, 6 or 7 proliferation cycles over 6 days compared to non-engineered cells in response to LoVo-OKT3, whereas CoStAR transduced and non-transduced cells went through an average of approximately 2 cycles over the same duration in response to wild-type LoVo.

Figure 5:
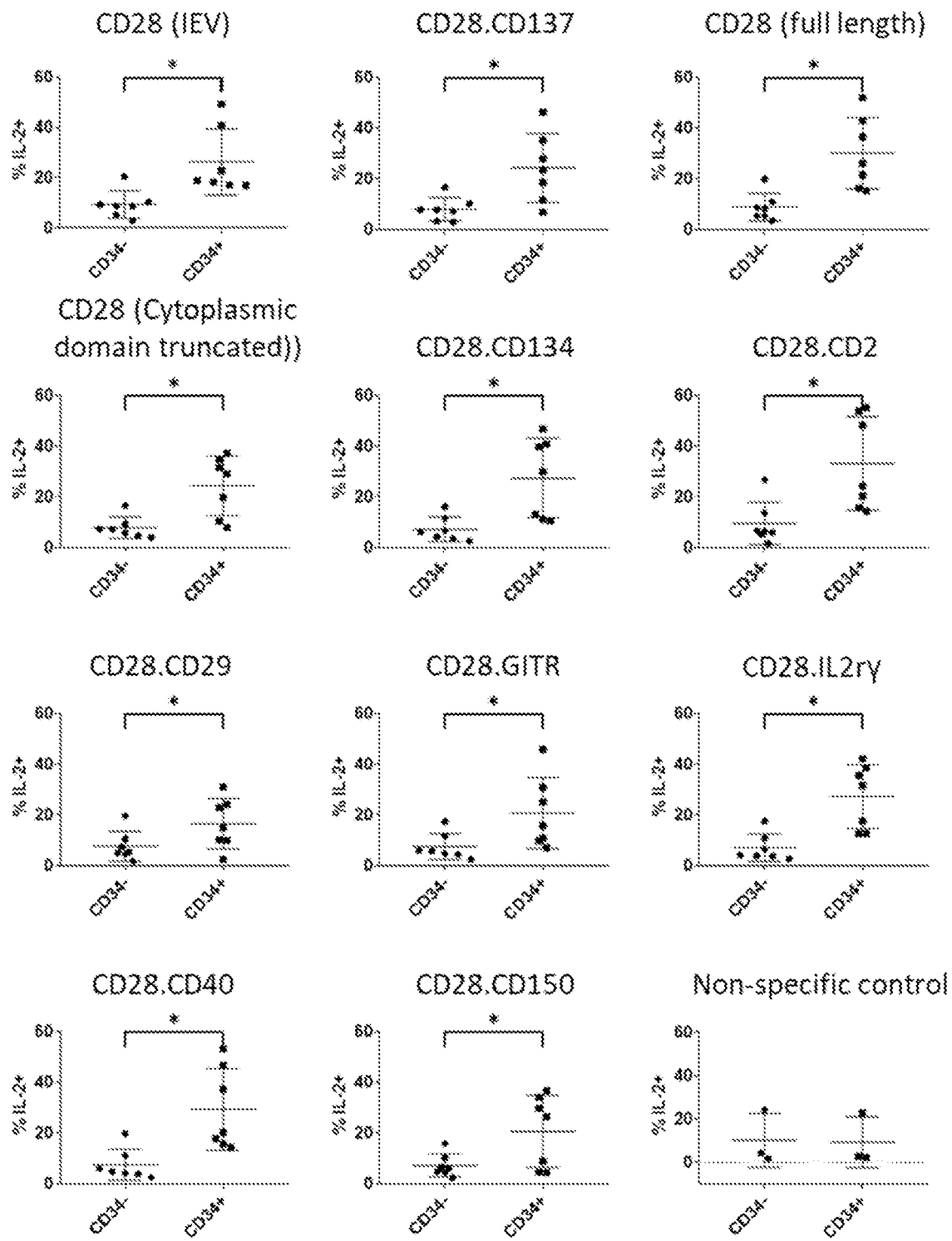
FIG. 5—IL-2 activity of CoStAR fusion receptors in primary human T-cells. Normal donor CD8+ T-cells from seven donors (except control CoStAR is three donors) were lentivirally transduced with the indicated CEA-targeting CoStARs and IL-2 production assessed after an overnight stimulation in the presence of LoVo-OKT3 cells. The proportion of IL-2 positive cells was determined using intracellular flow staining in both the CD34 negative (CoStAR non-transduced) and CD34+(CoStAR transduced) populations. Asterisks show significant differences between the transduced and non-transduced populations using paired Wilcoxon signed rank test with $*p<0.05$ FIG. 6A-6D—Multi parameter analysis of CoStAR activity in primary human T-cells. Normal donor CD8+ T-cells were lentivirally transduced with the indicated CEA-targeting CoStARs and IL-2 production assessed after an overnight stimulation in the presence of LoVo-OKT3 cells. The proportion of IL-2 (seven donors) (FIG. 6A), IFNγ (seven donors) (FIG. 6B), BCL-xL (five donors) (FIG. 6C) and CD107a (six donors) (FIG. 6D) positive cells was determined using intracellular flow staining in both the CD34 negative (CoStAR non-transduced) and CD34+(CoStAR transduced) populations. Control is a non-specific CA125 targeting CoStAR and is from three donors in all instances. Heat maps are averages of all donors with the intensity of colour related to the percentage of cells positive for a particular read out under the defined conditions.
Figure 6A:
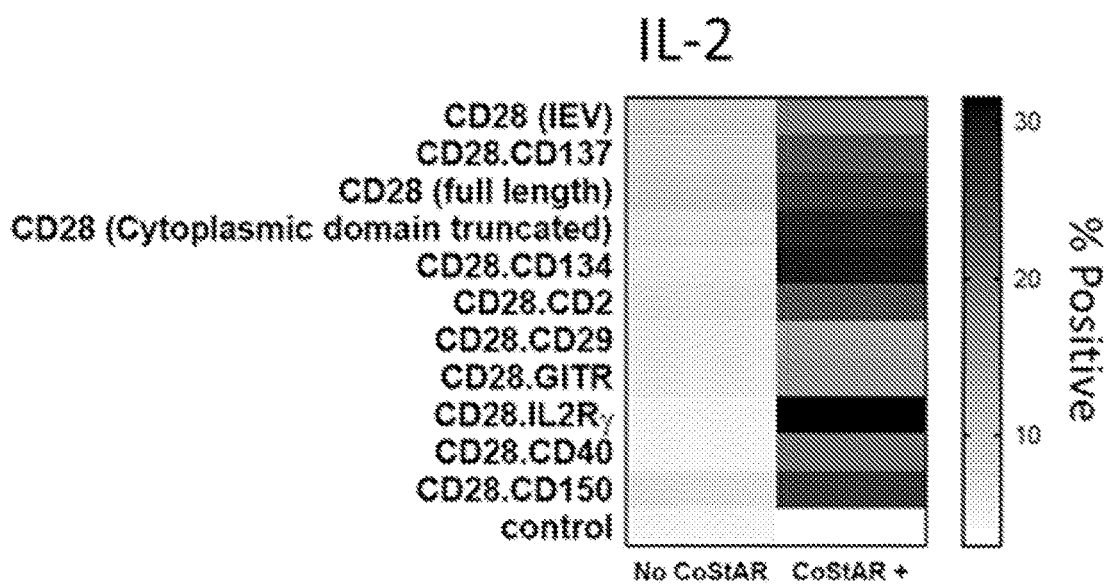
Figure 6B:
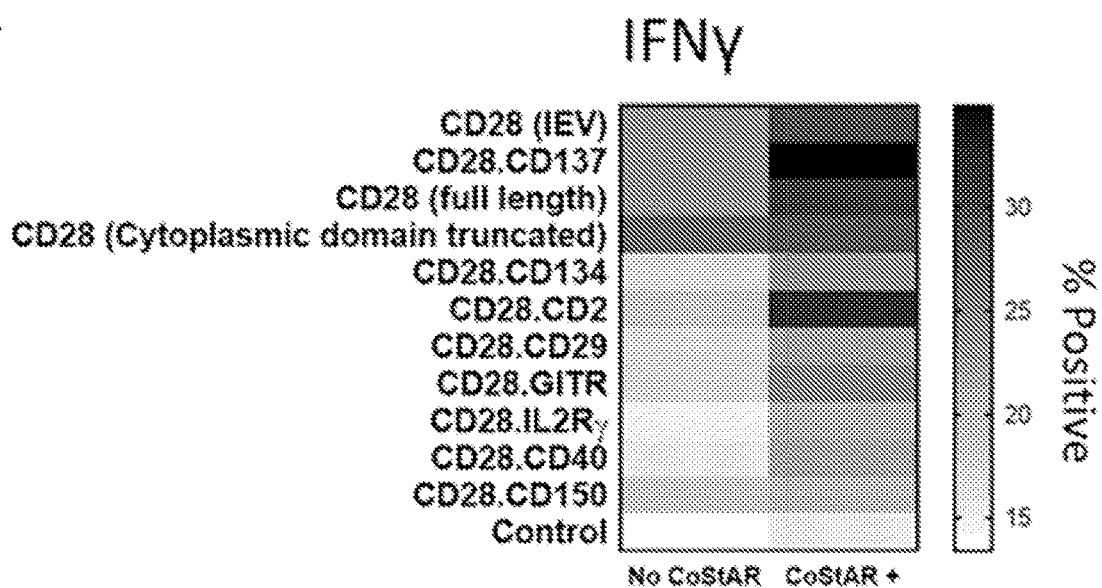
Figure 6C:
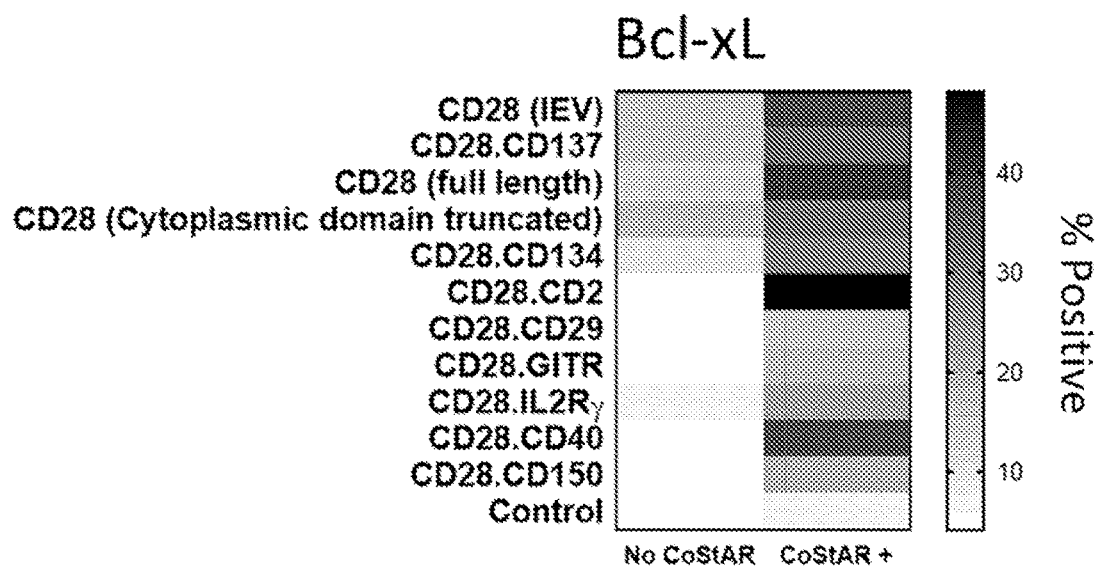
Figure 6D:
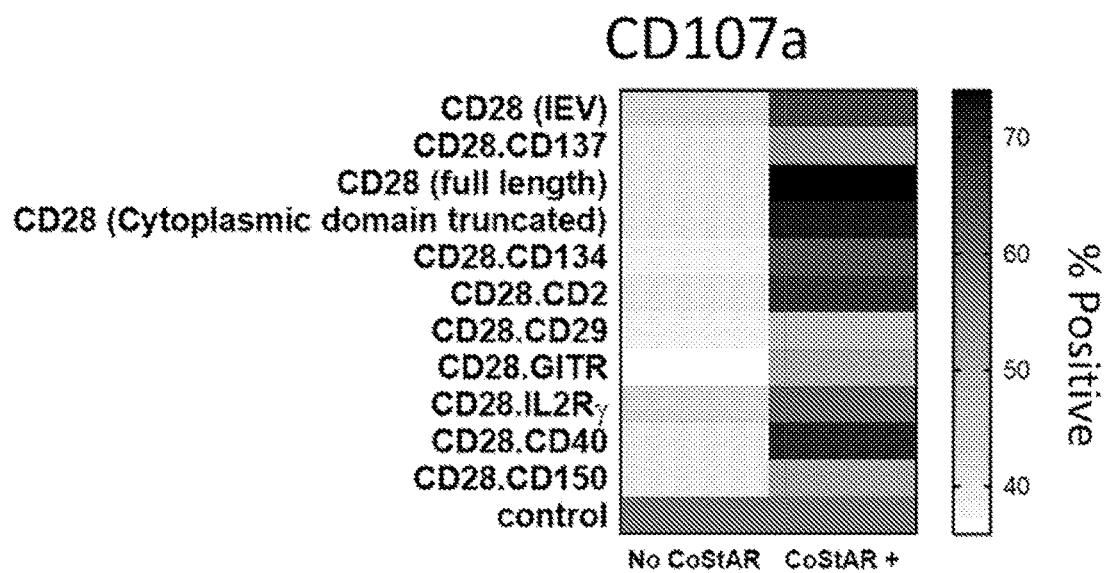

A variety of fusion receptors consisting of CD28 fused to an N-terminal additional costimulatory domain were generated. Costimulatory domains obtained from: CD137, CD2, CD29, CD134, CD150, CD40, GITR and the signalling domain from the IL-2 receptor γ-chain (IL2Rγ) were chosen. A receptor as close to that used in previous studies of inducible costimulation was included. This receptor designated CD28(IEV) is truncated such that the C-terminal motif of CD28 is the amino acid triad 'IEV'. Sequences were generated de novo by Genewiz and cloned into a lentiviral vector under an EF1α promoter along with a CD34 marker gene separated from the fusion CoStAR by a 2A self-cleaving peptide. Primary CD8+ T-cells were isolated using EasySep beads (StemCell Technologies) and activated with anti-CD3/anti-CD28 activation/expansion Dynabeads before addition of lentiviral particles. Following a short expansion period the cells were mixed with LoVo or LoVo-OKT3 cells, with the inclusion of anti-CD107a antibodies and brefeldin and monensin, and following a 16 hour incubation were fixed and stained with antibodies to the marker gene (CD34) as well as antibodies to IL-2, IFNγ and bcl-xL. Analysis was performed using a MACSQuant analyser and MACSQuantify software. FIG. 5 shows the IL-2 response from CD34− (CoStAR non-transduced) and CD34+ (CoStAR transduced). Statistical analysis demonstrated that all receptors tested induced a significant increase in the proportion of cells producing IL-2 when harbouring the variant CoStAR receptors. Three other read outs were concurrently measured: IFNγ, a cytokine released under normal signal 1 conditions but enhanced by costimulation; CD107a, a marker of degranulation; and bcl-xL, an antiapoptotic protein upregulated by costimulation. Engagement of CoStAR enhanced all the effector functions analysed to varying degrees. CD28.CD2 and CD28.CD40 fusions receptors appeared to elicit the most robust response of all the receptors tested (See FIG. 6)

Example 2

Figure 7:
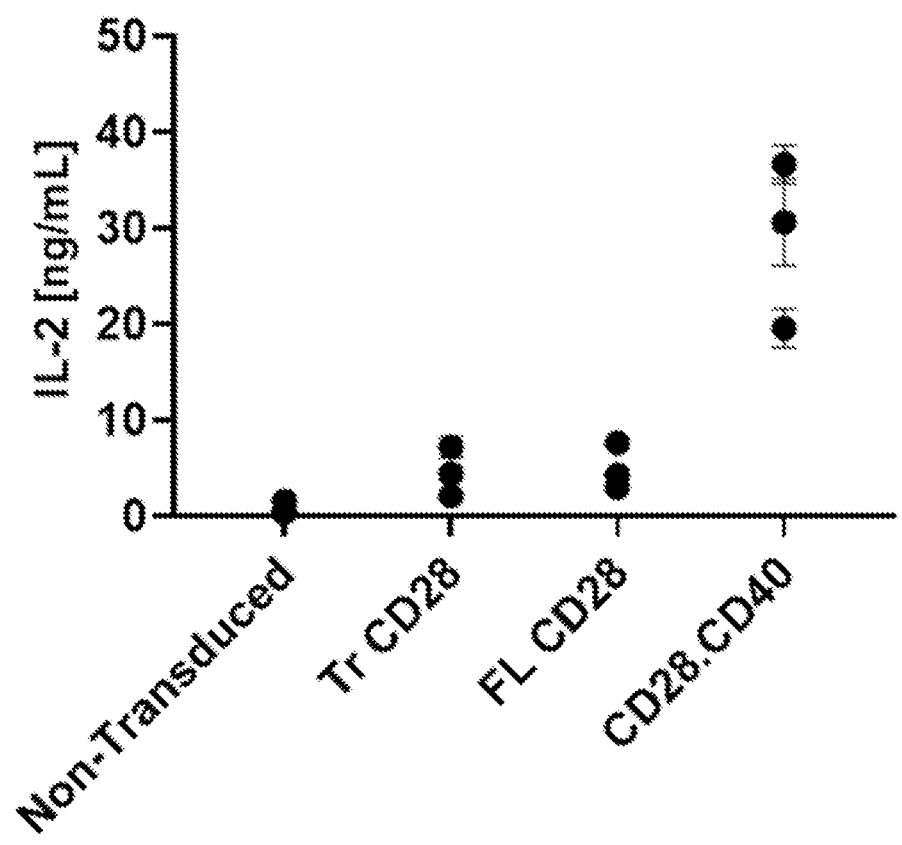
FIG. 7—CD40 enhances IL-2 production from CD28-based CoStARs. Primary human T-cells from three healthy donors were left non-transduced or transduced with either extracellular domain truncated CD28 (Tr CD28), full length CD28 (FL CD28), or CD28.CD40-based CoStARs harbouring a CEA specific scFv (MFE23). Transduced cells were selected using a CD34 marker gene and expanded prior to analysis. T-cells were mixed at an 8:1 effector to target ratio with OKT3 expressing CEA+LoVo cells for 20 hours before analysis of IL-2 production by ELISA.
Figure 8:
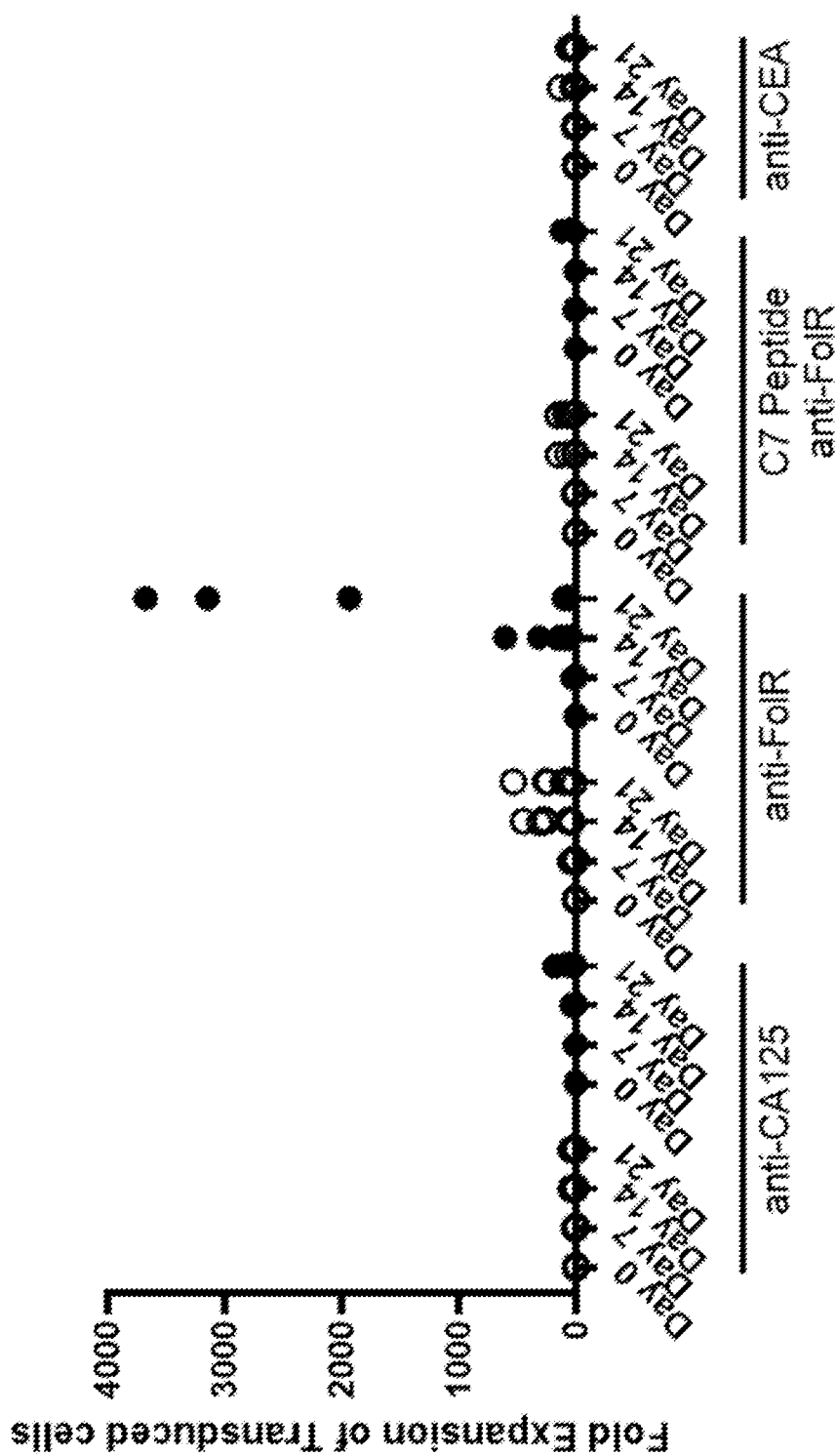
FIG. 8—Effect of signalling domain and target antigen on CoStAR-mediated T-cell expansion. T-cells were transduced with either DYKDDDDK (SEQ ID NO:449) epitope-tagged CD28 or CD28.CD40 based CoStARs harbouring CA125, FolR or CEA specific scFv, or FolR specific binding peptide (C7). T-cells were mixed with OKT3 expressing, CA125+/FolR+/CEA-cell line OVCAR3. The number of transduced cells were counted every 7 days up to 21 days, with fresh OVCAR3 cells added following each count.

The effect of CD28 and CD28.CD40 based CoStARs on population based cytokine secretion was compared. Primary T-cells from three donors were transduced with either the CD28(IEV) truncated CoStAR, full length CD28 CoStAR or CD28.CD40 CoStAR (having the full length CD28 as shown in SEQ ID NO:439, but lacking the N terminal N and K residues) or left non-transduced. T-cells were enriched for CoStAR expression using the CD34 marker gene, and following expansion cells were mixed with LoVo-OKT3 cells and IL-2 secretion analysed by ELISA (See FIG. 7). Non-transduced cells on average produced 0.80 ng/ml IL-2, with CD28(IEV) and full length CD28 CoStAR producing 4.6 and 5.0 ng/ml IL-2 respectively. However CD28.CD40 induced 29.0 ng/ml IL-2 on average across three donors thus demonstrating a clear benefit to incorporating CD40 into the basic CD28-based CoStAR.

Next the effect of CoStAR on T-cell expansion was analysed. T-cells from seven donors were transduced with either CD28 or CD28.CD40 CoStARs with either an anti-CA125 (196-14) or anti-Folate receptor (MOV-19) scFv, or an anti-Folate receptor peptide (C7) antigen binding domain. Additional cells were transduced with a CD28 CoStAR harboring an anti-CEA scFv as a mismatched control. Cells were then mixed with CA125+/Folate receptor+/CEA− cell line OvCAR3 engineered to express a membrane bound OKT3 (OvCAR-OKT3). T-cell counts were made after 7, 14 and 21 days, and fresh OvCAR-OKT3 added at days 7, and 14. Limited expansion of cells harbouring the anti-CA125 scFv was observed (mean fold expansion: CD28: 15.1; CD28.CD40: 69.1), however cells targeting Folate receptor with an scFv did expand in both the CD28 and CD28.CD40 cohorts (mean fold expansion: CD28: 186.7; CD28.CD40: 1295.0). More limited expansion was seen when the C7 peptide was used to target the Folate receptor (mean fold expansion: CD28: 71.5; CD28.CD40: 28.0). The control CEA targeting receptor demonstrated limited expansion (mean fold expansion: 28.0).

Figure 9:
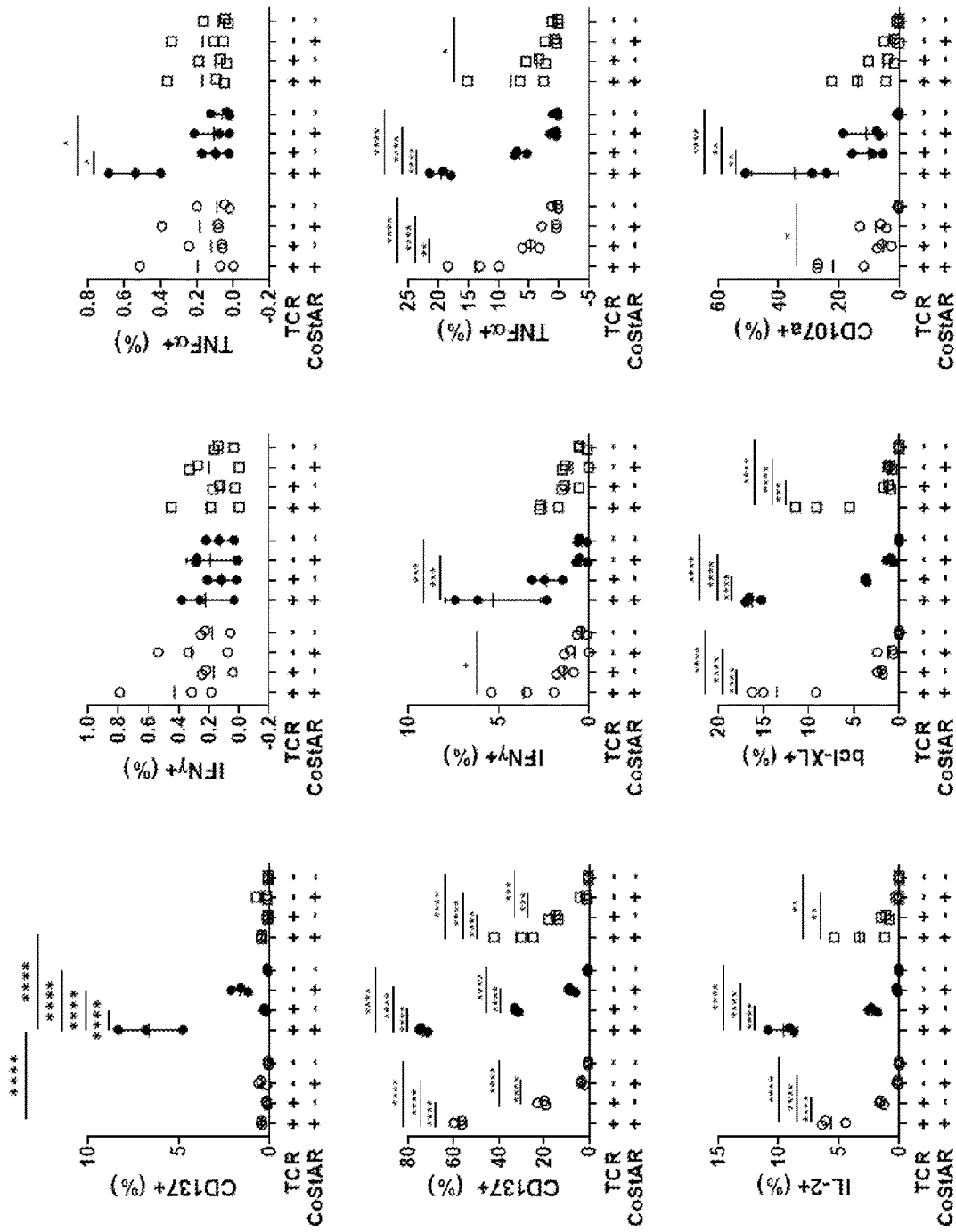
FIG. 9—Effect of signalling domain and target antigen on CoStAR-mediated T-cell expansion. T-cells were transduced with either DYKDDDDK (SEQ ID NO:449) epitope-tagged CD28 or CD28.CD40 based CoStARs harbouring CA125, FolR or CEA specific scFv, or FolR specific binding peptide (C7). T-cells were mixed with OKT3 expressing CA125+/FolR+/CEA-cell line OVCAR3. The number of transduced cells were counted every 7 days up to 21 days, with fresh OVCAR3 cells added following each count.
Figure 10A:
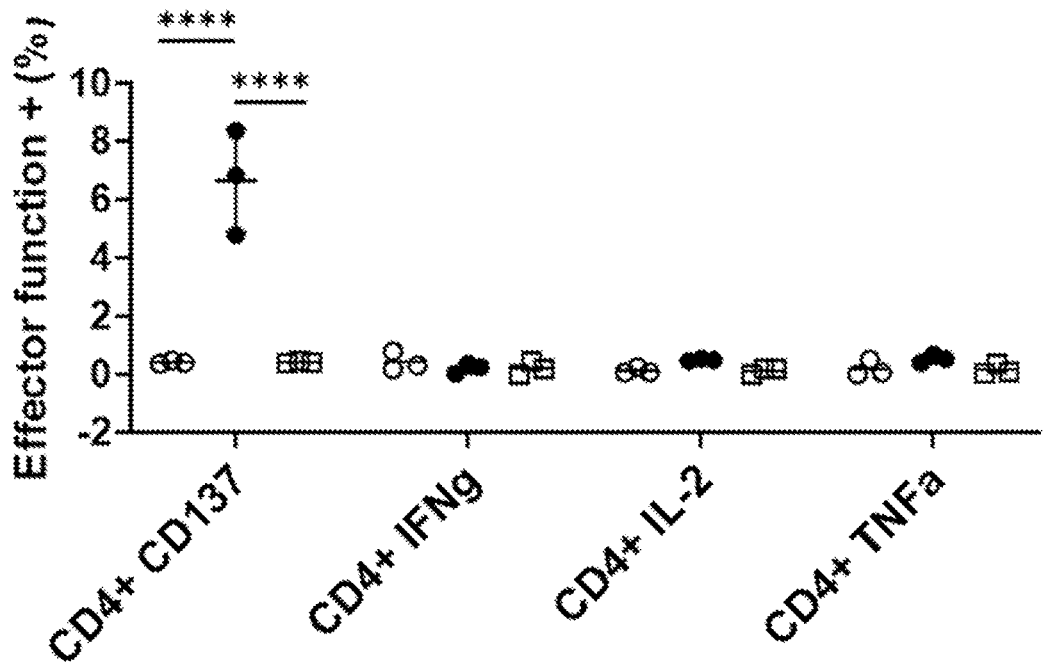
FIGS. 10A-10B—(10A and 10B) CD40 based CoStARs enhance costimulation of T-cells in a model of TCR-transfer. Primary human T-cells from three healthy donors were transduced with a CEA specific TCR plus either a DYKDDDDK-tagged CD28 or CD28.CD40 based CoStAR harbouring either an MFE (open or closed circles) or CA125 (open squares) specific scFv. T-cells were mixed at a 1:1 effector:target ratio with CEA+/CA125-H508 cells and intracellular cytokine staining performed to determine the number of responding CD4+ or CD8+ T-cells in the TCR+/CoStAR+, TCR+/CoStAR-, TCR-/CoStAR+ and TCR-/CoStAR- populations. A 2-way ANOVA (Tukeys test) was performed to determine significant differences in activity: $*p>0.05, p>0.01, *p>0.001, ****p>0.0001$.
Figure 10B:
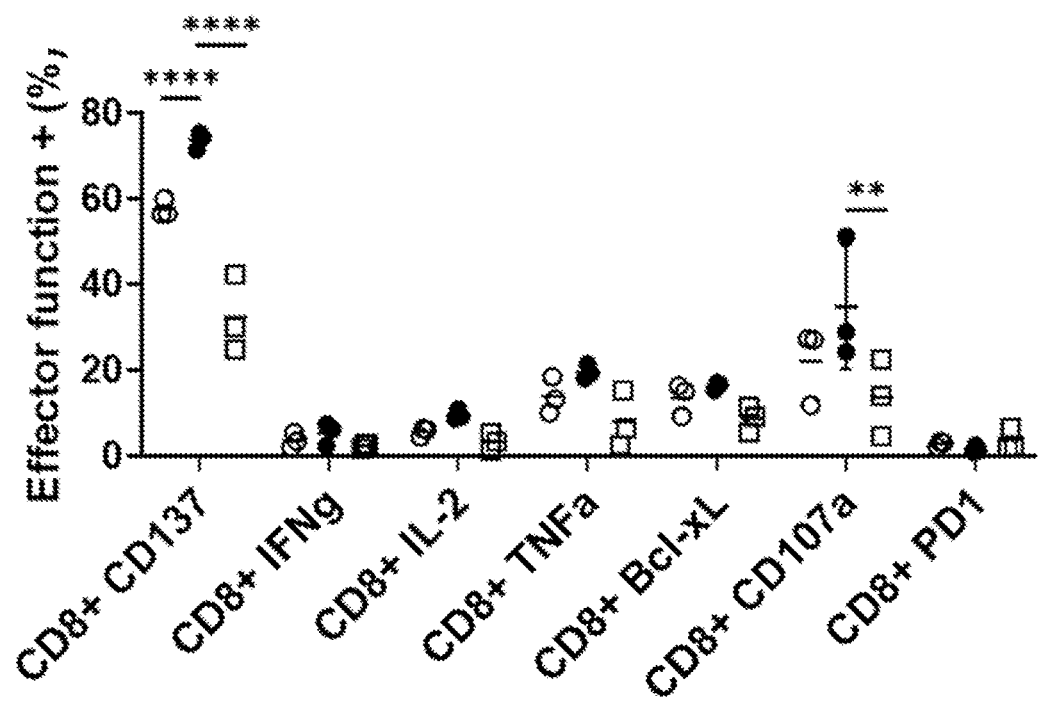

To better understand the synergy of signal 1 and signal 2 T-cells were engineered with a murine constant domain modified TCR which recognizes a CEA peptide (691-699) in the context of HLA-A*02 as well as the CD28 or CD28.CD40 CoStAR targeted towards cell surface CEA protein. As a control cells were also transduced with a CA125 specific CD28 CoStAR. The T-cells were mixed with HLA-A*02+/CEA+H508 cells and cytokine production analysed by intracellular flow cytometry staining. Flow cytometric gating was performed using antibodies directed towards the murine TCRO constant domain (marks the TCR engineered cells) as well as the DYKDDDDK (SEQ ID NO:449) epitope tag (marks the CoStAR engineered cells). Thus it was possible to analyse the TCR−/CoStAR−, TCR+/CoStAR−, TCR−/CoStAR+ and TCR+/CoStAR+ cells in each coculture well. Cytokine production was then plotted in each subpopulation in either the CD4+ or CD8+ T-cells (FIG. 9). In CD4+ cells CD28.CD40 CoStAR enhanced CD137 and TNFα production above TCR stimulation alone, however the TCR response in CD4+ cells was poor due to the dependency of the TCR on CD8. In CD8+ cells there was more robust effector activity with IL-2 and CD107a in particular showing a stronger induction in the CD28.CD40 CoStAR groups. To better compare the receptors the effector activity in just the TCR+/CoStAR+ groups was plotted in CD4+ and CD8+ cells (FIG. 10). In CD4+ cells induction of CD137 was significantly enhanced by CD28.CD40 compared to either CEA or mismatched targeting CD28 CoStAR. In CD8+ cells CD137 induction was significantly increased compared to either CEA or mismatched targeting CD28 CoStAR, whereas CD107a induction was increased compared to the control CoStAR. Thus CD28.CD40 shows enhanced effector activity across a broad range of models and effector activities.

Example 3

Figure 11:
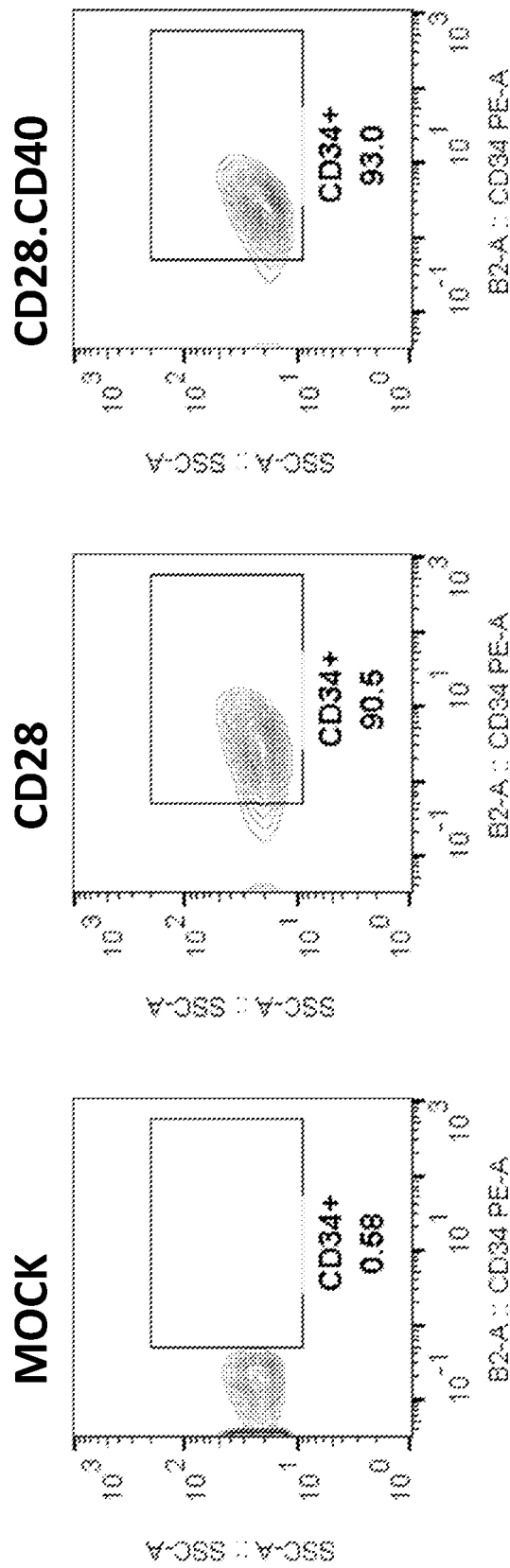
FIG. 11 depicts enrichment and expansion of primary human T-cells transduced to express costimulatory molecules. MFE23 is a single chain Fv antibody that has a high affinity for carcinoembryonic antigen (CEA). Primary human T-cells were mock transduced or transduced with MFE23.CD28 or MFE23.CD28.CD40 CoStAR, each harboring a CD34 marker gene separated by a 2A cleavage peptide. Following in vitro culture cells were enriched for CD34 using MACS™ paramagnetic selection reagents (Miltenyi Biotech) and then the cells expanded in number using irradiated feeder cells. Exemplary plots from one of three donors are shown.

To evaluate costimulation by CD40 bearing CoStARs, primary human T-cells were mock transduced or transduced with MFE23.CD28 or MFE23.CD28.CD40 CoStAR, each harbouring a CD34 marker gene separated by a 2A cleavage peptide. MFE23 is a single chain Fv antibody that has a high affinity for carcinoembryonic antigen (CEA). Following in vitro culture cells were enriched for CD34 using MACS™ paramagnetic selection reagents (Miltenyi Biotech) and then the cells expanded in number using irradiated feeder cells. MFE23.CD28 CoStAR strongly mediated expansion of CD34$^+$ T cells, and MFE23.CD28.CD40 CoStAR further enhanced expansion (FIG. 11).

Figures 12A, 12B, 12C, 12D:
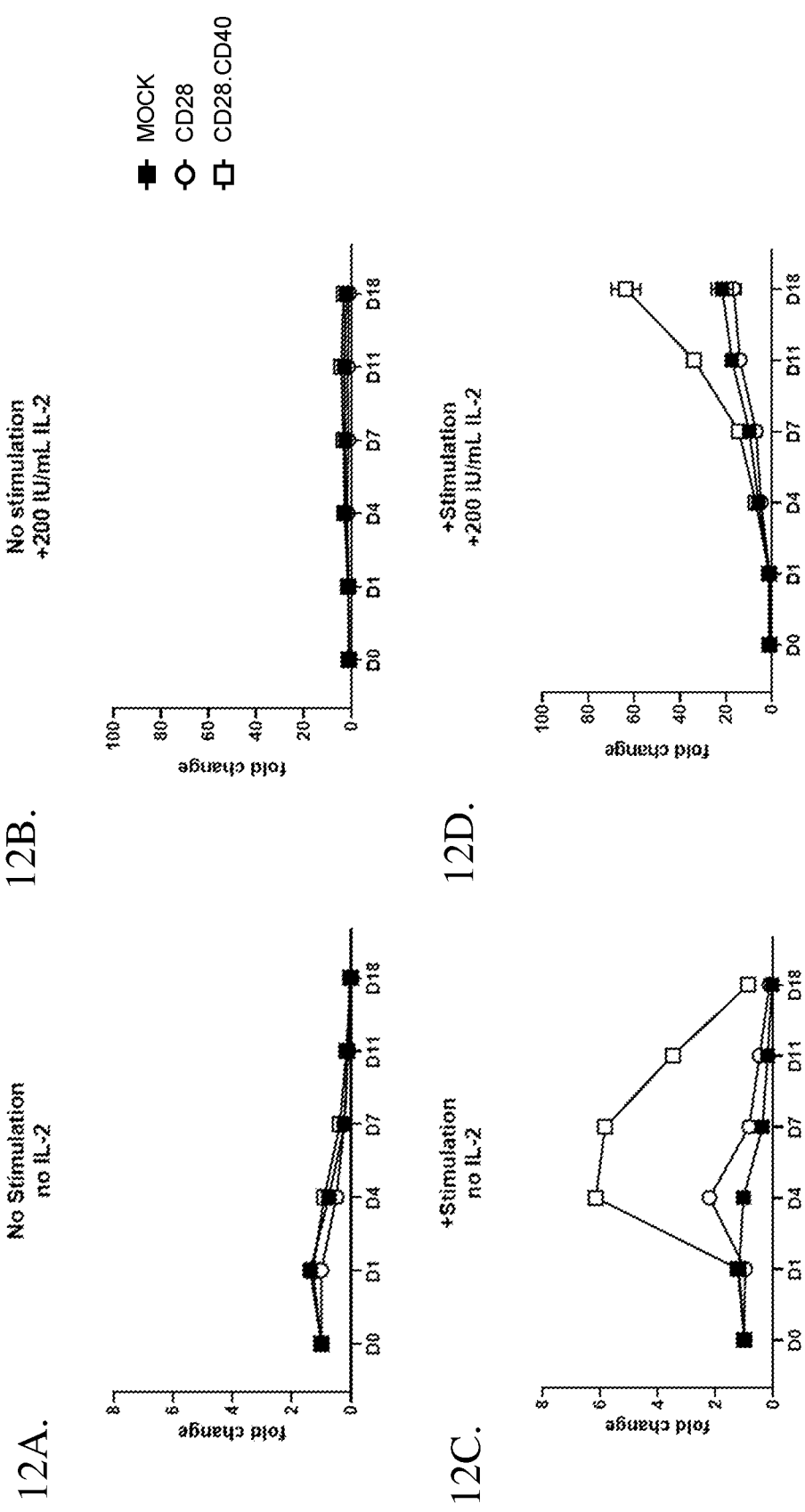
FIG. 12A-12D depicts expansion of T-cells transduced with costimulatory molecules in response to stimulation and exogenous IL-2. Cells were mock transduced or transduced with MFE23.CD28 or MFE23.CD28.CD40 CoStAR and cocultured with LoVo-OKT3 cells at an 8:1 effector:target ratio in the presence (200 IU/ml) or absence of exogenous IL-2. At days 1, 4, 7, 11 and 18 cells were taken and the number of viable T-cells enumerated by using anti-CD2 reagents on a MACSQuant flow cytometer. (12A) In the absence of stimulation by tumor and IL-2 cells declined in number as would be expected. (12B) In the absence of stimulation but presence of IL-2 there was a more apparent survival of the cells, but no specific growth. (12C) In the presence of tumor, but absence of IL-2 mock cells did not show specific survival. MFE23.CD28 CoStAR mediated an apparent doubling in expansion over the first four days followed by decline. MFE23.CD28.CD40 mediated a greater expansion up to day 7 followed by a steady decline. (12D) Under the same conditions but in the presence of IL-2 both mock and MFE23.CD28 transduced cells demonstrated a 20-fold expansion over 18 days, whereas MFE23.CD28.CD40 cells expanded by over 60-fold. Thus CD28.CD40 based receptors demonstrate superior expansion and survival under conditions of stimulation both in the presence and absence of exogenous IL-2.
Figures 13A, 13B, 13C, 13D, 13E, 13F:
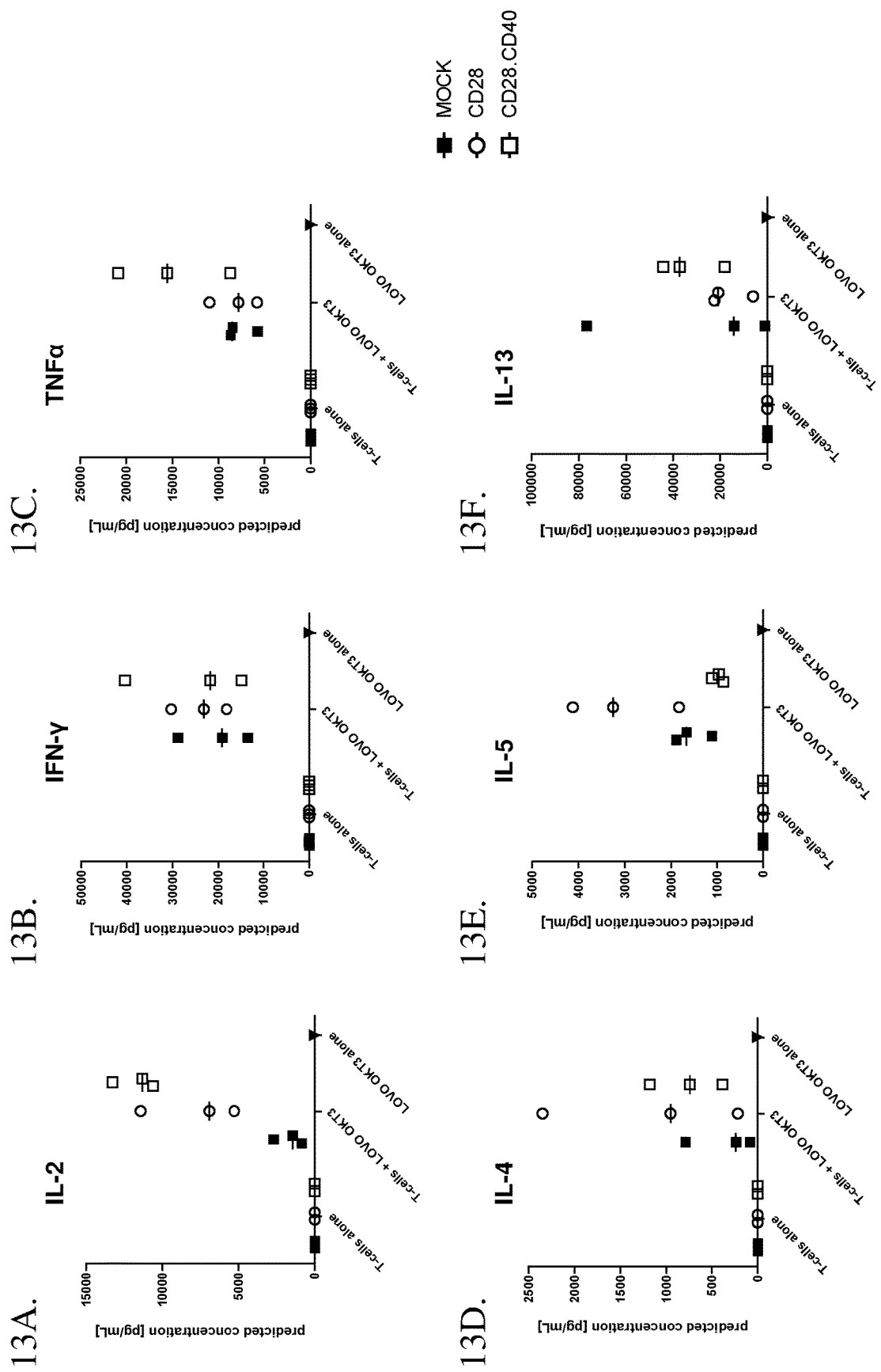
Figures 13G, 13H, 13I, 13J, 13K, 13L, 13M:
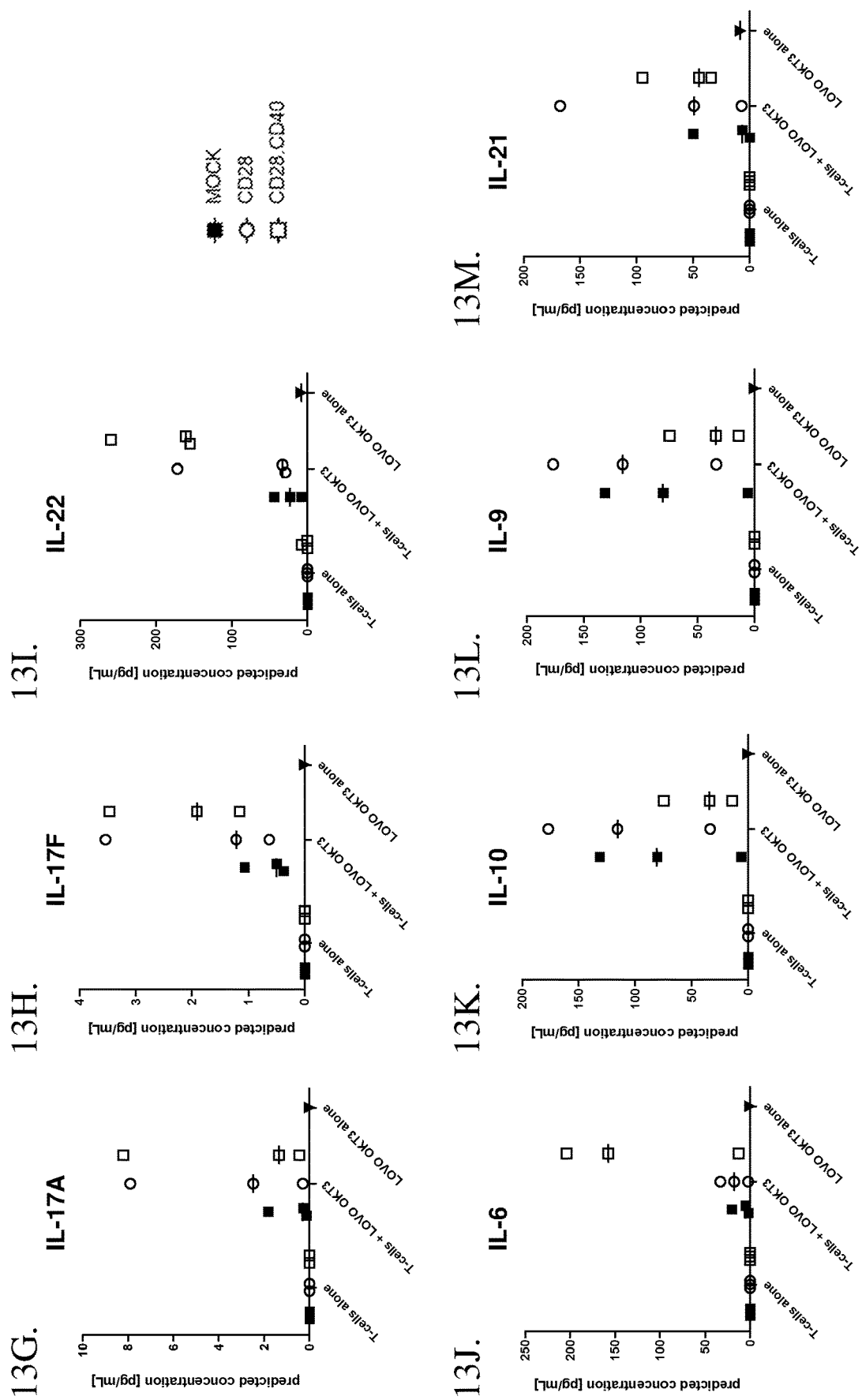
Figures 14A, 14B, 14C, 14D, 14E, 14F:
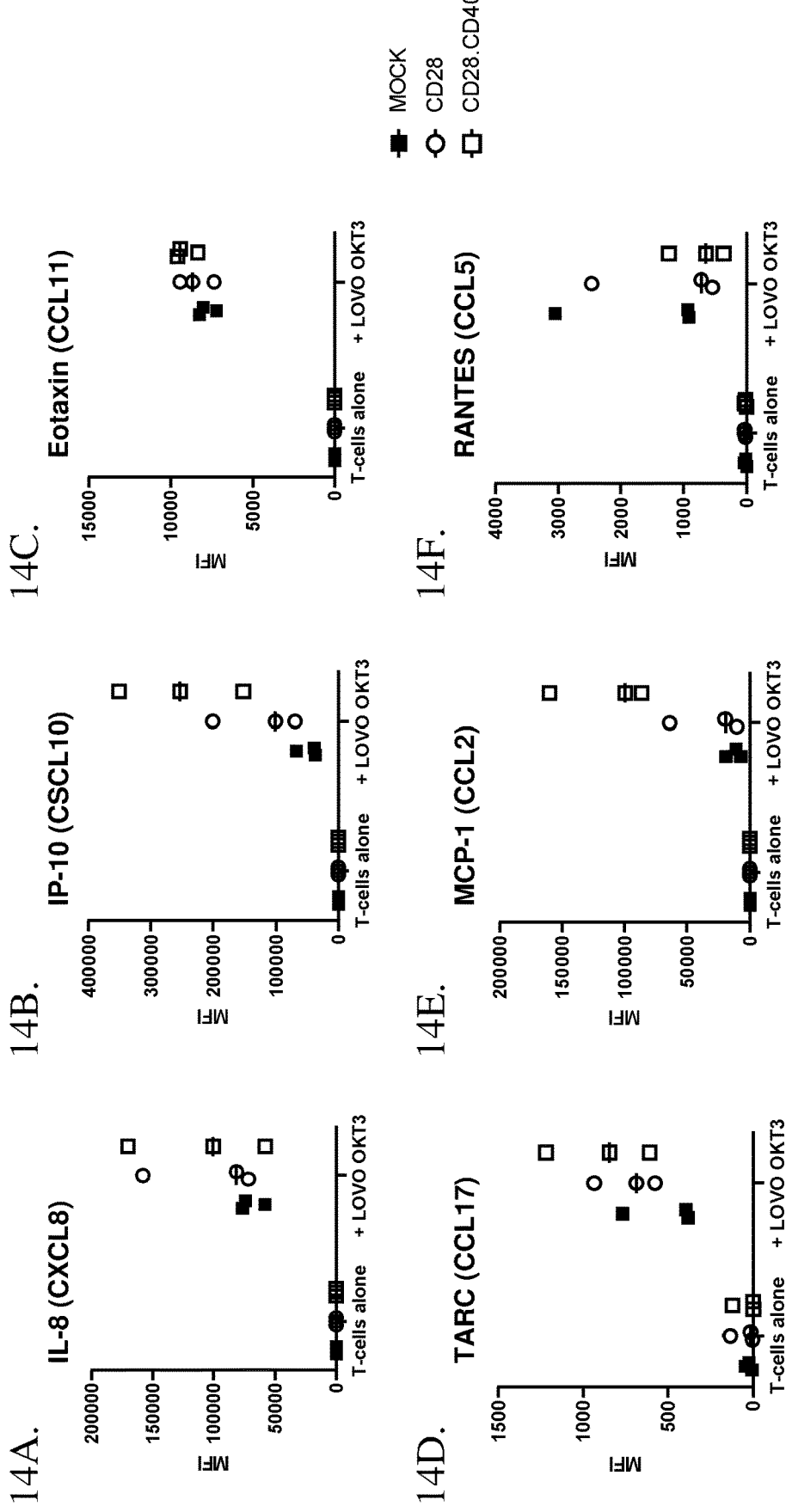
Figures 14G, 14H, 14I, 14J, 14K, 14L, 14M:
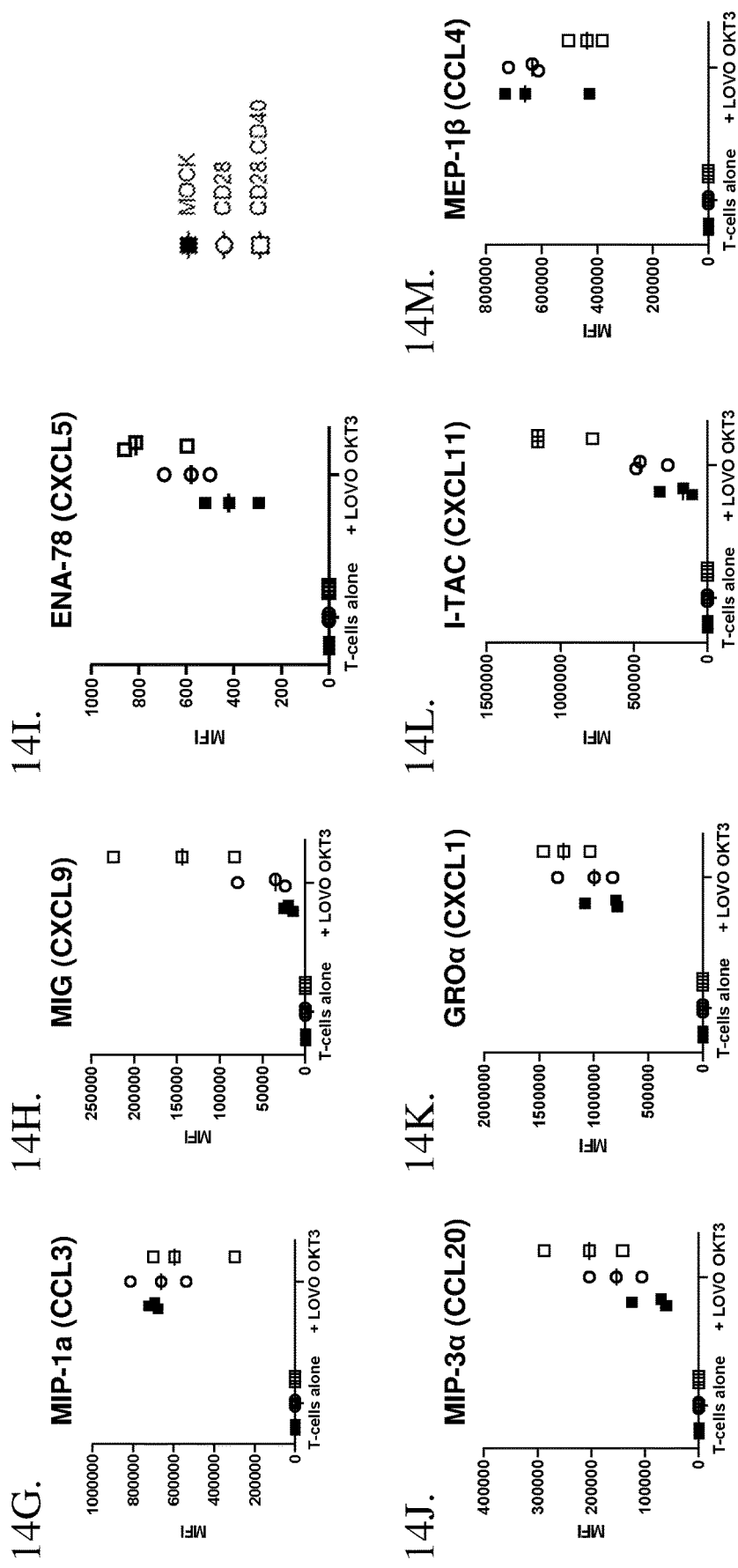
Figures 15A, 15B, 15C, 15D:
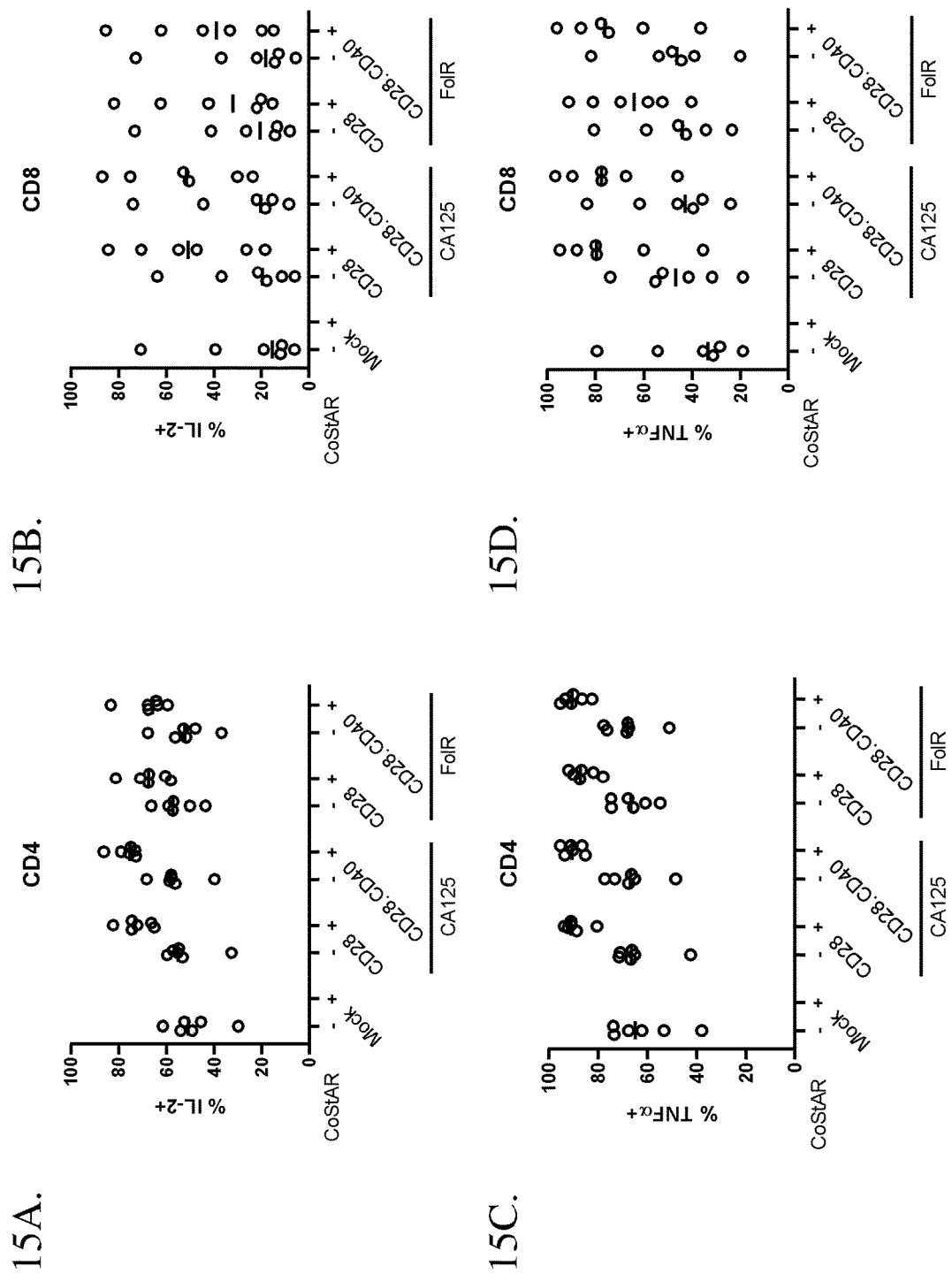
Figures 15E, 15F, 15G, 15H:
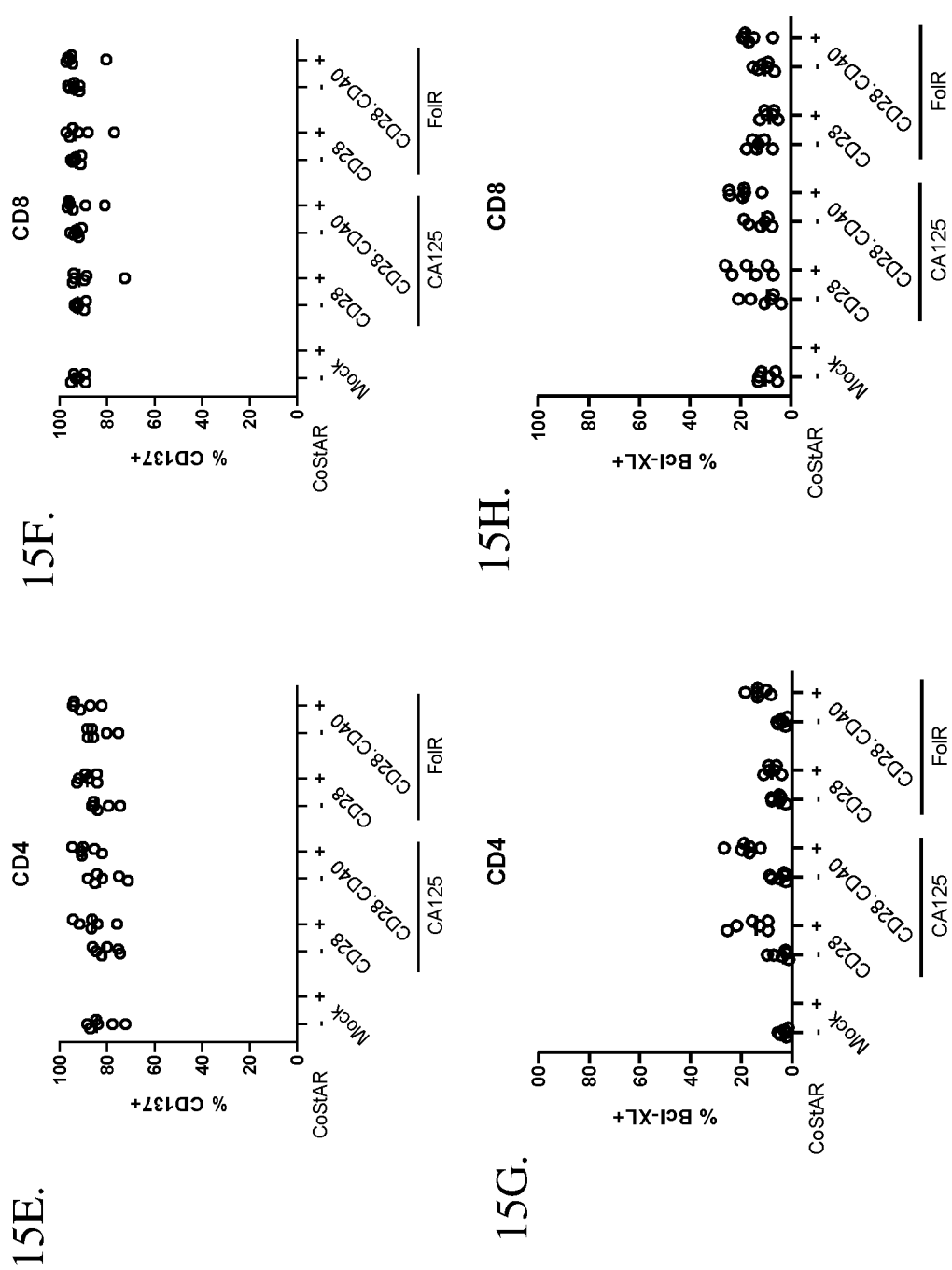

To evaluate costimulatory activity and persistence, T cells mock transduced or transfected with MFE23.CD28 or MFE23.CD28.CD40 were cocultured with LoVo-OKT3 cells at an 8:1 effector:target ratio in the presence (200 IU/ml) or absence of exogenous IL-2. At days 1, 4, 7, 11 and 18 cells were taken and the number of viable T-cells enumerated by using anti-CD2 reagents on a MACSQuant flow cytometer. In the absence of stimulation by tumor and IL-2, cells declined in number as would be expected (FIG. 12A). In the absence of stimulation but presence of IL-2 there was a more apparent survival of the cells, but no specific growth (FIG. 12B). In the presence of tumor, but absence of IL-2 mock cells did not show specific survival. MFE23.CD28 CoStAR mediated an apparent doubling in expansion over the first four days followed by decline. MFE23.CD28.CD40 mediated a greater expansion up to day 7 followed by a steady decline (FIG. 12C). Under the same conditions but in the presence of IL-2 both mock and MFE23.CD28 transduced cells demonstrated a 20-fold expansion over 18 days, whereas MFE23.CD28.CD40 cells expanded by over 60-fold (FIG. 12D). Thus CD28.CD40 based receptors demonstrated superior expansion and survival under conditions of stimulation both in the presence and absence of exogenous IL-2.

Mock transduced and T cells transduced with MFE23.CD28 or MFE23.CD28.CD40 CoStARs were then tested for cytokine production. Bead array analysis was performed on supernatants obtained from T-cell/tumour cocultures. Engineered T-cells were incubated at a 1:1 effector:target ratio with LoVo-OKT3 cells for 24 hours and supernatant collected. Conditioned supernatant was also collected from an equal number of T-cells alone, or LoVo-OKT3 cells alone. Production of IL-2, IFN-γ, TNFα, IL-4, IL-5, IL-13, IL-17A, IL-17F, IL-22, IL-6, IL-10, IL-9, and IL-21 was analysed using a Legendplex™ Human TH1/TH2 cytokine panel (Biolegend) (FIG. 13A-13M). Cytokines were either very low or undetectable in media from T-cells or tumour alone. However when cocultured with tumour cytokine production was enhanced. MFE23.CD28 enhanced production of IL-2, IL-5, IL-17A/17F, IL-10, IL-9 and IL-21 compared to mock. However, MFE23.CD28.CD40 also enhanced production of TNFα, IL-13 and IL-22. MFE23.CD28.CD40 also enhanced the production of a number of cytokines greater than that elicited by MFE23.CD28 (IL-2, IL-9 and IL-17F), but also reduced the production of some cytokines below the levels seen with MFE23.CD28 (IL-5 and IL-10). Together this data demonstrates that addition of CD40 to CD28-based Costimulatory receptors enhances and/or modulates their specific activity with respect to chemokine production.

Mock transduced and T cells transduced with MFE23.CD28 or MFE23.CD28.CD40 CoStARs were further tested for chemokine production. Production of IL-8 (CXCL8), IP-10 (CSCL10), Eotaxin (CCL11), TARC (CCL17), MCP-1 (CCL2), RANTES (CCL5), MIP-1a (CCL3), MIG (CXCL9), ENA-78 (CXCL5), MIP-3a (CCL20), GROα (CXCL1), I-TAC (CXCL11), and MEP-113 (CCL4) was analysed using a Legendplex™ Human Pro inflammatory chemokine panel. (FIG. 14A-14M). Chemokines were either very low or undetectable in media from T-cells alone. However when cocultured with tumor, chemokine production was enhanced. MFE23.CD28 enhanced production of CXCL5, CXCL10, CXCL11, CCL17 and CCL20 compared to mock. However, MFE23.CD28.CD40 also enhanced production of CCL2, CXCL1 and CXCL9. MFE23.CD28.CD40 also further enhanced the production of certain cytokines to a greater amount than that elicited by MFE23.CD28 (CXCL1, CXCL9, CXCL10, CXCL11, CCL17, CCL2, CXCL9, CCL5 and CCL20), while reducing the production of some cytokines below the levels seen with MFE23.CD28 (CCL4). Together this data demonstrates that addition of CD40 to CD28-based Costimulatory receptors enhances and/or modulates their specific activity with respect to chemokine production.

CoStARs were tested for functional activity against cancer targets. Cells were transduced with CD28 or CD28.CD40 CoStARs engineered with an scFv binding domain specific for FolR or CA125 (scFv MOV19 and scFv 196-14 respectively). Human folate receptor alpha (FolR) represents a suitable target for a number of tumours including ovarian, head and neck, renal and lung and CA125 represents an alternative target for ovarian cancer. Primary human T-cells from six healthy donors were engineered with either 196-14.CD28, 196-14.CD28.CD40, MOV19.CD28 or MOV19.CD28.CD40 receptors, all harbouring a DYKDDDDK epitope tag for detection. Transduced cells were mixed with FolR+/CA125+ OvCAR-OKT3 cells before analysis of effector activity using intracellular staining in the epitope tag positive and negative populations. Specific enhancement of effector activity determined by production of IL-2 (FIGS. 15A and 15B), TNFα (FIGS. 15C and 15D), CD137 (FIGS. 15E and 15F), and BCL-xL (FIGS. 15G and 15H) was observed in CD28 and CD28.CD40 engineered cells compared to mock transduce cells in response to both CA125 and FolR, although specific BCL-xL induction by MOV19.CD28 was not substantial as compared to MOV19.CD28.CD40.

Figures 16A, 16B, 16C, 16D, 16E, 16F:
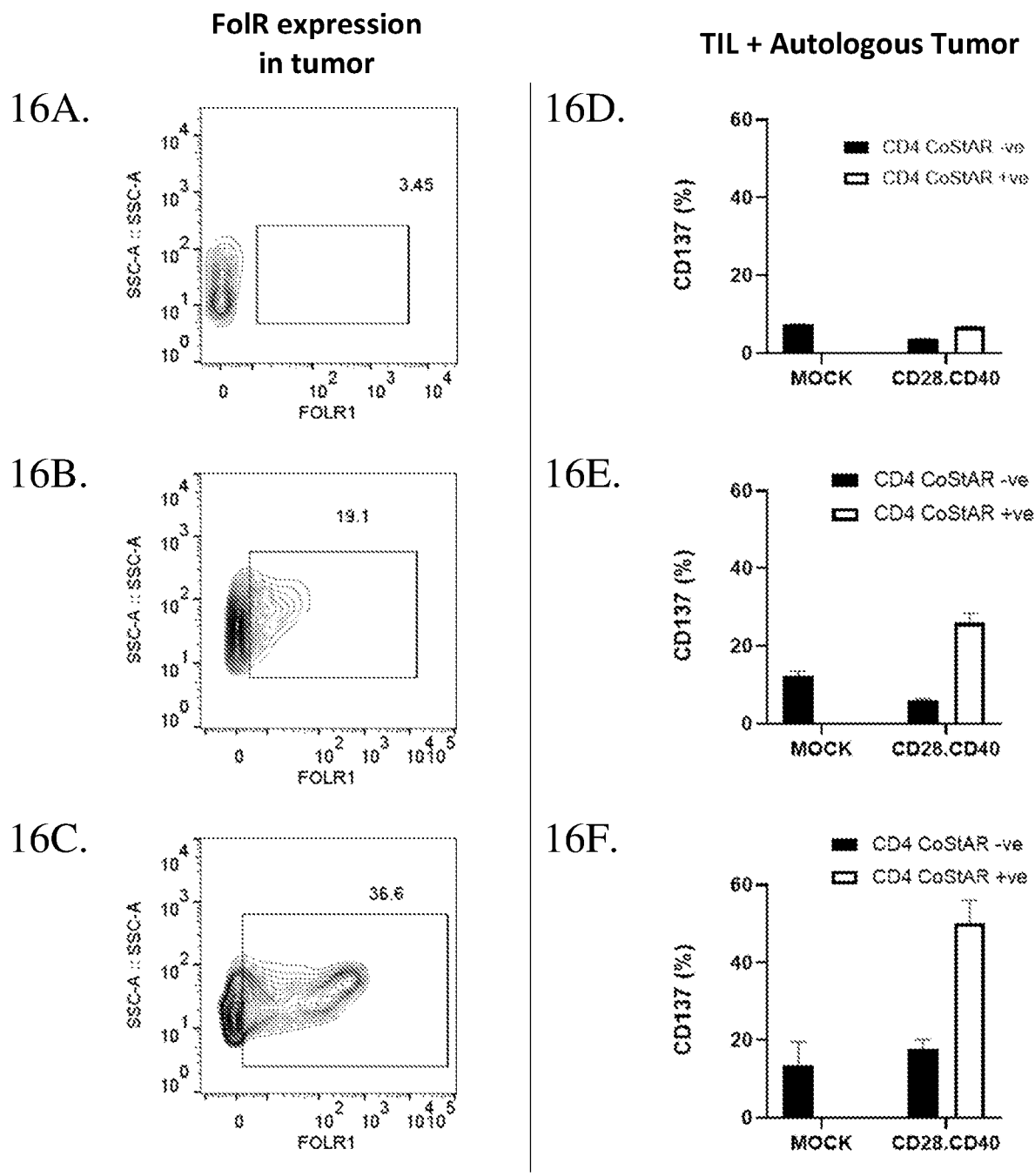

Mock transduced TILs or TILs engineered with MOV19.CD28.CD40 CoStAR were evaluated for expansion and CD137 production stimulated by patient matched tumour digest (FIG. 16). Three donor tumours were tested which displayed varying levels of FolR on the digest, ranging from negative (6A), low expression (6B) to high expression (6C). Mock and CoStAR negative TIL in the CoStAR engineered populations of TIL matched for the FolR negative digest demonstrated similar levels of CD137 upregulation following tumour coculture which was not enhanced by the presence of CoStAR (FIG. 16D). In the TIL exposed to FolR low expressing digest there was an enhancement in activity in the CoStAR+ cells compared to CoStAR−, with CD137 expression increasing from <10% to >20% (FIG. 16E). In the TIL exposed to FolR high expressing tumour digest there was an increase in activity from around 20% in the CoStAR− population, up to approximately 50% in the CoStAR+ population (FIG. 16F).

A FolR targeting CoStAR was examined for enhancement of effector functions. MOV19.CD28.CD40 enhanced CD137 expression from ~20% to ~50% (FIG. 17A), TNFα production from 10% to 15% (FIG. 17B) and IL-2 production from 2% to 5% (FIG. 17C) in response to FolR+tumour digest.

Figures 18A, 18B, 18C, 18D, 18E, 18F:
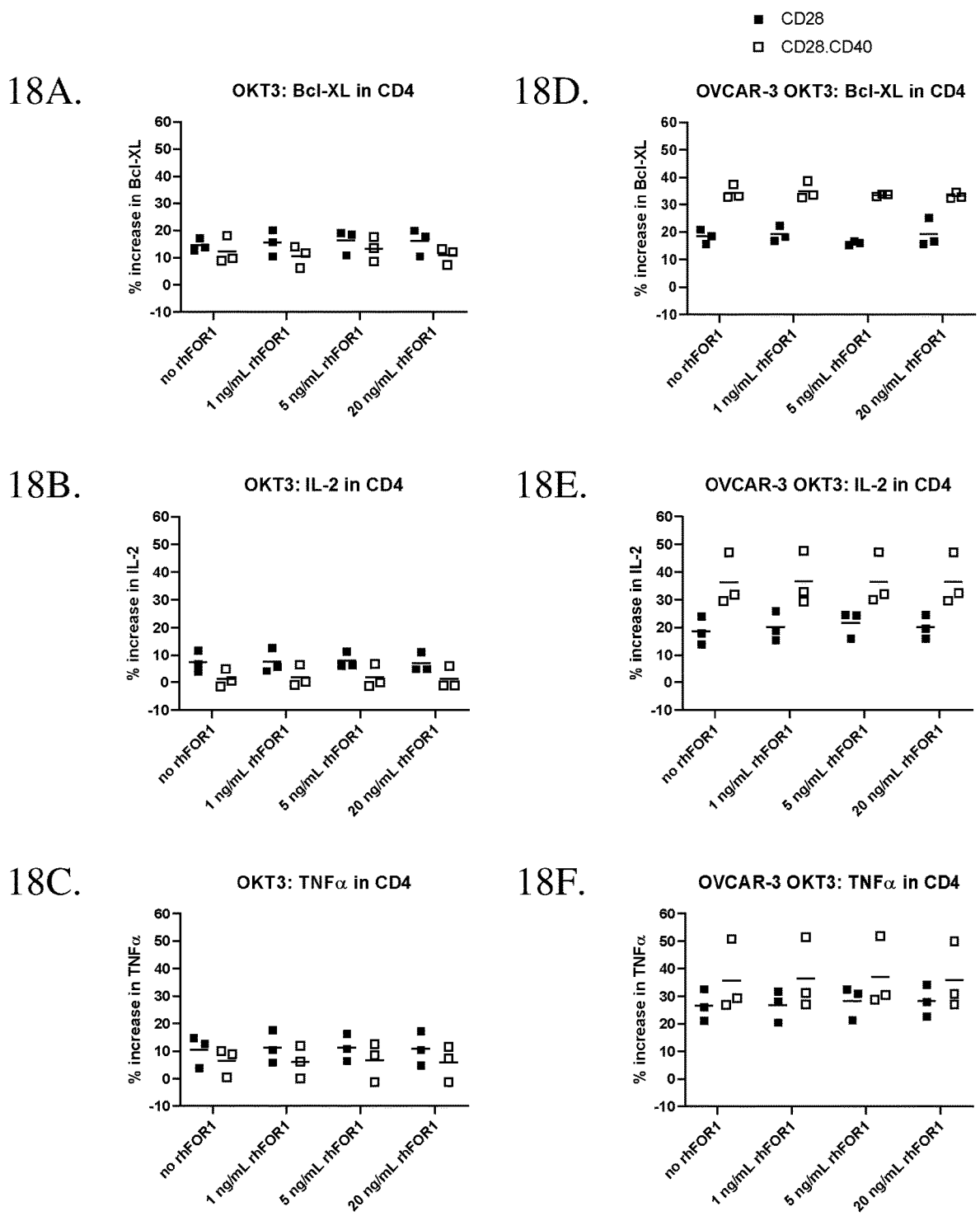

CoStAR mediated stimulation by soluble ligand was also examined. T-cells from three healthy donors were engineered with MOV19.CD28 or MOV19.CD28.CD40 CoStAR and activated with either immobilised OKT3, providing stimulation in the absence of FolR, or with OvCAR-OKT3, to provide TCR and CoStAR activity. Bcl-XL activity was increased from between 10 and 20% across the three donors following OKT3 stimulation (FIG. 18A) whereas IL-2 was increased between 0 and 12% (FIG. 18B) and TNFα increased between 0 and 20% (FIG. 18C). The presence of exogenous soluble FolR did not enhance any of these particular effector functions. In the presence of OvCAR-OKT3 Bcl-XL induction was enhanced by ~20% in CD28 CoStAR and by ~35% in CD28.CD40 CoStAR (FIG. 18D), IL-2 induction was enhanced by ~20% in CD28 CoStAR and 30-50% in CD28.CD40 CoStAR (FIG. 18E) and TNFα production was enhanced by 20-30% in CD28 CoStAR and 25-50% in CD28.CD40 CoStAR (FIG. 18F). Exogenous soluble FolR did not have an inhibitory effect on any of these effector functions.

Example 4

Materials and Methods

Construct design—The MFE23, MOV19 and 196-14 CoStAR constructs include an MFE23 (CEA specific), MOV19 (Folate receptor α specific) or 196-14 (CA125 specific) derived single chain antibody fragment nucleotide sequence with an oncostatin M1 leader sequence fused to a costimulatory domain. The costimulatory domains contain an extracellular spacer region and transmembrane domain derived from human CD8 or CD28 and a signalling domain of either CD28, CD2 or CD137 and/or wild-type or mutant CD40 variants. Some CoStARs detailed herein comprise a human PD1 extracellular domain fused to CD28 and CD40. Receptors were cloned with a P2A cleavage sequence and a truncated form of human CD34 to permit detection of transduced cells. The CoStAR nucleotide sequence was codon optimised and gene synthesised by Genewiz Inc. The constructs were cloned into a third generation lentiviral vector.

Peripheral blood mononuclear cells were isolated from normal healthy donors before activation for 24 hours with T-cell activation and expansion beads (Invitrogen) according to the manufacturer's instructions before addition of lentiviral supernatants.

Cell transduction was assessed 96 hours post infection using CEA.hFc protein (R&D Systems) and anti-hFc-PE secondary, plus anti-CD34-APC or by anti-CD34-PE antibodies alone. Cells were then expanded further using ×10 donor mismatched irradiated PBMC feeders at a 1:20-1:200 ratio in RPMI+10% FCS with the addition of 30 ng/ml OKT3 and 200 IU/ml IL-2. After 14 days the cells were stained as previous and stored ready for assay.

Functionality assays were performed by mixing CoStAR positive or negative cells with wild-type or OKT3 engineered CEA-Positive LoVo cells. Briefly, T-cells were mixed with LoVo cells at varying ratios in 96-well plates. For flow analysis cocultures were incubated with Brefeldin and monensin and anti-CD107a antibodies for 16 hours following which cells were stained with Fixable Viability Dye ef450 (eBiosciences), fixed with 4% paraformaldehyde and then permeabilised using Fix/Perm wash buffer (BD Biosciences). Cells were then stained with anti-CD34 or anti DYKDDDDK antibodies to differentiate between the CoStAR+ and CoStAR-populations, anti-IL-2, anti-TNFα and anti-IFNγ antibodies (Biolegend). For soluble analyte analysis supernatants were collected for analysis by ELISA, cytokine bead array (LEGENDPLEX™ Human Th Cytokine Panel (12-plex)) or chemokine bead array (LEGENDPLEX™ Human Proinflammatory Chemokine Panel (13-plex).

Proliferation assays were performed by mixing T-cells and tumour cells at an 8:1 effector:target ratio in complete T-cell media (TCM: RPMI supplemented with 10% FCS, 0.01 M HEPES and 1% Penicillin/streptomycin, 50 mM β-mercaptoethanol) in the presence or absence of IL-2. Cell counts were made at indicated time points and fresh tumour cells were added in restimulation assays at a final E:T of 8:1. Cell counts for proliferation assays were performed by taking cells from the wells and staining with anti-CD2 PerCP eFluor710 antibody (eBioscience, UK) for 20 min in the dark, followed by DRAQ7 staining and counts made using a MACSQuant analyser.

Example 5

CEA Example 5

PD1 fusion receptors: Primary human T-cells isolated from three separate healthy donors are transduced with the indicated PD1 fusion CoStAR receptors, or an MFE23.CD28.CD40 CoStAR (positive control) or 196-14.CD28.CD40 (negative control). PD1 fusion receptors are chosen based on the format detailed in Ankri et al. J Immunol 2013; 191:4121-4129 and Prosser et al. Molecular Immunology 51 (2012) 263-272, but with the addition of CD40 to the signalling domain. For some experiments, cells are used following Dynabead removal in flow cytometric based assays. To this end transduced T-cells are cocultured with LoVo-OKT3 (PDL1+, CEA+, CA125−) in the presence of either Nivolumab (anti-PD1) or an isotype matched (IgG4) control antibody, or no antibody addition, and then effector function activity (CD137, IFNγ, TNFα and IL-2) is assessed by flow cytometry in the CD34+(CoStAR+) and CD34− (CoStAR−) cells. PD1.CD28.CD40 fusion receptor positive cells elicit enhanced effector function activity compared to either non-transduced cells or PD1.CD28.CD40 receptor negative cells in response to LoVo-OKT3 cells. This effect is also observed in the presence of IgG4 isotype control incubated wells but not Nivolumanb treated wells. Control cells transduced with MFE23.CD28.CD40, but not 196-15.CD28.CD40 also demonstrate enhanced effector activity in response to LoVo-OKT3.

Transduced cells are enriched via the CD34 cell surface marker and incubated with LoVo-OKT3 cells overnight before analysis of cell culture supernatant via ELISA and cytokine and chemokine bead array. PD1.CD28.CD40 fusion receptor engineered cells produce more IL-2 and CXCL10 compared to non-transduced cells LoVo-OKT3 cells. This effect is also observed in the presence of IgG4 isotype control antibody but not Nivolumab (anti-PD1). Control cells transduced with MFE23.CD28.CD40, but not 196-15.CD28.CD40 also demonstrate enhanced IL-2 and CXCL10 production in response to LoVo-OKT3.

Signaling domain analysis: Primary human T-cells isolated from three separate healthy donors are transduced with the indicated signaling domain variant CoStARs (MFE23.CD28, MFE23.CD28.CD40, MFE23.CD8ec/tm.CD28.CD40, MFE23.CD8ec/tm.CD40, MFE23.CD8ec/tm.CD137.CD40, MFE23.CD8ec/tm.CD137, MFE23.CD8ec/tm.CD2.CD40, MFE23.CD8ec/tm.CD2), or a 196-14.CD28.CD40 (negative control) CoStAR. CD8ec/tm indicates a component comprising a spacer and transmembrane domain from CD8 (e.g., SEQ ID NO:20). Transduced cells are enriched via the CD34 cell surface marker and incubated with LoVo-OKT3 cells overnight before analysis of cell culture supernatant via ELISA. MFE23.CD28.CD40 produces more IL-2 than MFE23.CD28, MFE23.CD8ec/tm.CD28.CD40 is very similar in responsiveness to MFE23.CD28.CD40 demonstrating that the choice of spacer domain does not impact on CoStAR activity. The addition of CD40 to MFE23.CD8ec/tm.CD137 or MFE23.CD8ec/tm.CD2 enhances the specific activity of these receptors with regards to IL-2 production and production of other cytokines and chemokines, thus demonstrating that addition of CD40 improves the activity of CoStAR based on receptor signalling domains other than CD28.

To determine which receptor signaling motifs contribute to CD40 enhancement of CoStAR activity, variant receptors are generated harbouring mutations in the TRAF6 binding motif (MFE23.CD28.CD40 (PQEINF mutated to AQAINF)), the TRAF2 binding motif (MFE23.CD28.CD40 (SVQE mutated to AVQA)) or the TRAF1/2/3/5 binding motif (MFE23.CD28.CD40 (PVQET mutated to AVAEA)). Also generated is a receptor with a triplicated CD40 signalling domain MFE23.CD28.CD40(×3), and a receptor with a P227A mutation. Primary human T-cells isolated from three separate healthy donors are transduced with the indicated CoStARs and cells enriched for CoStAR expression via CD34. Cocultures are set up with LoVo-OKT3 cells and supernatants collected for ELISA and cytokine/chemokine bead array. All receptors harbouring a mutation in any one of the three signalling motifs demonstrate reduced effector activity in response to LoVo-OKT3 cells (IL-2 and/or CXCL10). Cells expressing the CD28.CD40 (×3) receptor or P227A mutation demonstrate enhanced activity in response to LoVo-OKT3.

To determine which receptor signaling motifs contribute to CD40 enhancement of CoStAR activity, variant receptors were generated harbouring mutations in the TRAF6 binding motif (MFE23.CD28.CD40 (PQEINF mutated to AQAINF)), the TRAF2 binding motif (MFE23.CD28.CD40 (SVQE mutated to AVQA)) or the TRAF1/2/3/5 binding motif (MFE23.CD28.CD40 (PVQET mutated to AVAEA)). Primary human T-cells isolated from three separate healthy donors were transduced with the indicated CoStARs and cells enriched for CoStAR expression via CD34. Cocultures were set up with LoVo-OKT3 cells and supernatants collected for cytokine analysis.

IL2 production by non-transduced cells was very low, but elevated in cells expressing the wild-type MFE23.CD28.CD40 CoStAR. IL2 production was not largely affected by mutations to the SVQE, PQEINF or Q263A mutation. However, mutation to the PVQET motif had a dramatic effect on IL2 production by T-cells.

Concurrently proliferation of engineered T-cells was assessed in response to LoVo-OKT3 cells over 2 rounds of stimulation with LoVo-OKT3 cells. Non-transduced cells did not survive even one round of stimulation, whereas cells expressing the wild-type receptor underwent a 10-fold expansion over 2 rounds of stimulation over 14-days. Cells harboring either a SVQE-AVQA mutation, or PQEINF-AQAINF mutation displayed a reduced capacity to undergo proliferation, this was further exacerbated in cells harboring a Q263A mutation. However, cells harboring a PVQET-AVAEA mutation in the TRAF2/3 binding region displayed a profound inability to proliferate over 2 rounds of stimulation.

Example 6

To evaluate the in vivo anti-tumor activity of T cells transduced with CD40 bearing CoStARs, primary human T-cells are mock transduced or transduced with MOV19.CD28.CD40 CoStAR construct followed by in vitro expansion and cryopreservation. MOV19 is a single chain Fv antibody that has a high affinity for Folate Receptor alpha (FolR1). Immunocompromised mice are implanted with an established ovarian cancer cell line (A2870, OVCAR-5, OVCAR-8 or SK-OV-3), which is allowed to grow in the animal for few days. Mice are subsequently staged according to their tumor burden, and finally injected with the mock transduced T cells or MOV19.CD28.CD40 transduced T cells. Shortly after the T cell dosing, some of the mice are injected with intravenous IL-2 (5 µg IL-2, Q2Dx7) to support the engraftment and initial expansion of T cells. The final study design contains 5 groups (each one containing 5 mice): PBS (no cells dosed), mock transduced T cells, mock transduced T cells with IL-2 supplementation, MOV19.CD28.CD40 transduced T cells and MOV19.CD28.CD40 transduced T cells with IL-2 supplementation. Tumor growth and mice survival is monitored on weekly basis for a total of 40 days.

Mice administered with MOV19.CD28.CD40 transduced cells show better tumor control and prolonged survival compared to the mock transduced groups, whether or not supplemented with IL-2. This data demonstrates the ability of the CoStAR platform to improve in vivo the T cell anti-tumor response and also illustrates how this improved response is independent of the presence of exogenous IL-2.

Example 7

Design of CoStARs that bind to CEA—The CoStAR consists of a CEA specific MFE23, humanised (hu) MFE23, CEA6, BW431/26 or huT84.66 derived single chain antibody fragment nucleotide sequence with an oncostatin M1, CD8α, CD2, IL-2, GM-CSF or hIgGκVIII leader sequence. Each CoStAR has an extracellular spacer domain derived from CD8 or CD28 or truncated CD28 and a signalling domain derived from CD28 and CD40. The constructs are cloned into pSF.Lenti (Oxford Genetics) containing an MND promoter, and separated from a truncated CD34 marker gene via a P2A cleavage sequence.

Design of CoStARs that bind to MSLN—The CoStAR consists of a MSLN specific SS1, humanized SS1 (M5), HN1, M912, HuYP218 or P4 derived single chain antibody fragment nucleotide sequence with an oncostatin M1, CD8α, CD2, IL-2, GM-CSF or hIgGκ VIII leader sequence. Each CoStAR has an extracellular spacer domain derived from CD8 or CD28 or truncated CD28 and a signalling domain derived from CD28 and CD40. The constructs were cloned into pSF.Lenti (Oxford Genetics) containing an MND promoter, and separated from a truncated CD34 marker gene via a P2A cleavage sequence.

Lentiviral Production—Lentiviral production is performed using a three-plasmid packaging system (Cell Biolabs, San Diego, USA) by mixing 10 µg of each plasmid, plus 10 µg of the pSF.Lenti lentiviral plasmid containing the transgene, together in serum free RPMI containing 50 mM $CaCl_2$). The mixture is added dropwise to a 50% confluent monolayer of 293T cells in 75 $cm^2$ flasks. The viral supernatants are collected at 48 and 72 h post transfection, pooled and concentrated using Lenti-X lentiviral supernatant concentration (Takara Bio Inc. Japan) solution according to the manufacturer's instructions. Lentiviral supernatants are concentrated 10-fold and used to directly infect primary human T-cells at an MOI of 3-5 in the presence of 4 µg/ml polybrene (Sigma-Aldrich, Dorset, UK). Peripheral blood mononuclear cells are isolated from normal healthy donors before activation for 24 hours with T-cell activation and expansion beads (Invitrogen) according to the manufacturer's instructions before addition of lentiviral supernatants.

Cell transduction is assessed 96 hours post infection using CEA.hFc protein and anti-hFc-PE secondary, plus anti-CD34-APC or by anti-CD34-PE antibodies alone. Cells are then expanded further using ×10 donor mismatched irradiated PBMC feeders at a 1:200 ratio in T-cell media (RPMI 1640, 10% FBS, 10 mM HEPES, 50 µM β-mercaptoethanol and 50 u/ml Penicillin/streptomycin), 200 IU/ml IL-2 and a final concentration of 30 ng/ml anti-CD3 (OKT3). After 12-14 days the cells are stained as previous and stored ready for assay.

Functionality assays are performed by mixing CoStAR positive or negative cells with wild-type or OKT3 engineered CEA or MSLN positive cell lines (LoVo, HT29, SW480, H508). Briefly, T-cells are mixed with target cells at varying ratios in 96-well plates and cytokine release measured by ELISA and MSD analysis.

Cytotoxicity assays are performed using the xCELLigence RTCA SP real time cell analyser system (Acea). A programme was generated to test well conductivity (cell index) of a 96-well PET E-plate every 15 min for the duration of the experiment (up to 250 hr). 50 µL T cell medium was added to the wells which were to have cell index tested and incubated at room temperature (RT) for 30 minutes. The E-plate was added to the RTCA SP device and background conductivity readings measured.

The optimal density of target cells to seed is defined as that which reaches a stable cell index between 24- and 36-hours after the beginning of the assay and does not decrease without intervention (i.e. addition of Triton-x-100 or effector cell populations) before the end of the assay. Target cells at optimal density for killing assays (cell line dependent) are counted using a quantitative method capable of dead-cell discrimination. The E-plate is removed from the device and the optimal density of live cells is added to the wells containing T cell medium at a final volume of 100 µL before incubation for 30 minutes at RT.

The E-plate us then placed back on the analyser and cell index values acquired until a stable cell index is observed, at which point the programme is paused and the E-plate removed from the RTCA SP device. Treatments are added to the appropriate wells. Treatments consist of either 100 µL T cell medium (no treatment control), or the same volume containing effector cells or 0.5% Triton-x-100 (full lysis control). Effector cell counting uses a quantitative method capable of dead- and apoptotic-cell discrimination. The number of effectors to target cells varied depending on the experiment.

During data analysis, the cell index is normalised using the following equation in the RTCA software package:

$$NormalisedCIti = CIti/CInml\_time$$

Where CIti=Cell index (CI) at a specific time point, and CInml_time=CI at the time point prior to addition of T cells.

Data is then further manipulated relative to the full lysis control to give % cytolysis:

$$\% \text{ Cytolysisst} = [1-(NCIst)/(AvgNCIRt)] \times 100$$

where, NCIst is the Normalised Cell Index for the sample and NCIRt is the average of Normalise Cell Index for the matching reference wells.

Repeat stimulation assays are performed by mixing $5 \times 10^4$ CoStAR transduced or mock-transduced cells at an 8:1 E:T ration with LoVo-OKT3 cells in the absence of exogenous IL-2, in triplicate well of a 96-well U-bottom plate. T-cell counts are made on D1, 4 and 7 via flow cytometric assessment of numbers based on aCD2 gating, and fresh tumour cells added at seven day intervals. Relative expansion is assessed by splitting of wells and enumeration of fold change based upon the original seeding density with the proportion of cells removed for counting also factored in.

Results

A model system is developed to evaluate the impact of various structural components of CEA and MSLN directed CoStAR receptors. To this end the signal peptide (SP), single chain antibody fragment (scFv) and extracellular spacer (ES) are assessed for their impact on expression and function.

The impact of the signal peptide on expression of the CoStAR is tested, as it is known that different signal peptides can affect expression of various recombinant proteins (REF). The MFE23.CD28.CD40 CoStAR receptors are generated with various different leader sequences (which encode the desired signal peptide) sequences. These include signal peptides derived from: Oncostatin M1 (OSM), IL2, CD2, CD8α, GMCSF and hIgGκ VIII. Each leader sequence is cloned in frame with the MFE23 scFv sequence to generate SP.MFE23.CD28.CD40.P2A.tCD34. A Jurkat cell line model is selected to investigate the relative expression of each SP modified CoStAR relative to the tCD34 marker gene. To this end Jurkat JRT3-T3.5 T-cells are incubated with lentiviral particles at an MOI of 5. Seven days post transduction the cells are stained with anti-CD34 antibodies to stain for the transduced cells, and CEA.hFc protein followed by anti-hFc secondary antibodies to identify for the CEA CoStAR. All SP modified CoStAR variants tested are found to be expressed in the CD34+ proportion of the JRT3-T3.5 cells.

Next, the impact of different CEA specific scFv in the context of CoStAR is assessed, as well as investigating different spacer domains. Six different scFvs are compared; as well as the MFE23 sequence described above (Chester et al. 1994), including an MFE23 K>Q mutant, humanised (Hu) MFE23 (Begent et al. 2003), CEA6 (Jackson et al. 1998), BW431/26 (Seenmann et al. 1991) and HuT84.66 (Yazaki et al. 2005).

Primary human T-cells are isolated from Buffy coats obtained from the NHSBT. T-cells are isolated by Ficoll-mediated isolation and T-cell negative isolation kits (Stem-Cell Technologies). The isolated T-cells are activated with human T-cell activation and expansion beads (Invitrogen, UK). Cells are incubated with concentrated lentiviral particles, encoding CEA CoStARs containing the OSM SP, and expanded over a number of days. Cells are enriched for CoStAR expression using anti-CD34 antibodies to obtain T-cell populations greater than 90% CoStAR positive before being placed in a rapid expansion protocol (REP), with irradiated buffy coat derived PBMCs as outlined in the materials and methods.

A physiologically relevant in vitro model is employed to test the impact of CoStAR on T-cell activity. Transduced and non-transduced cells are tested against the CEA+ cell lines LoVo, H508, SW480 or HT29. The murine CEA− cell line Ba/F3 is engineered to express CEA as a control. To enable activation of the T-cells in response to the unmatched tumour lines the tumour cells are engineered to express an anti-CD3 single chain antibody fragment anchored to the cell membrane by way of a synthetic transmembrane domain and split from a GFP marker gene using an IRES element to visualise transduced cells using flow cytometry. Cell lines are also engineered to express firefly-luciferase (ffLuc) under puromycin selection to permit analysis of target cell lysis.

Non-transduced and CoStAR transduced T-cells are mixed at varying effector:target ratios with wild-type or OKT3-engineered tumour cell lines. After 24 hours coculture media is taken for IL-2 ELISA measurement. Activation dependent IL-2 secretion is observed from both CoStAR+ and CoStAR− T-cell populations from all donors in response to OKT3 engineered cells with only background IL-2 secretion seen from transduced and non-transduced T-cells in response to un-engineered tumour cells. In all donors tested, the presence of CEA CoStAR enhances effector activity (IL2, IL3, CXCL10) towards OKT3 engineered CEA+tumour lines.

Cocultures with Ba/F3 cells demonstrate the targeted approach of the CEA CoStARs. Coculture of CEA CoStAR engineered cells with Ba/F3 or Ba/F3-CEA does not result in specific IL2 release whereas incubation with Ba/F3-OKT3 enhances IL-2 secretion. However, incubation of T-cells with Ba/F3-OKT3/CEA significantly enhances IL2 secretion compared to Ba/F3-OKT3 alone.

The impact of CoStAR on tumour cell killing is determined. Transduced or non-transduced T-cells are mixed with wild-type or OKT3-GFP engineered tumour cells and quantified residual tumour cell derived luciferase activity at defined time points. The presence of CoStAR enhances the ability of T-cells to mediate target cell lysis. This enhanced ability of CoStAR+ cells to mediate anti-tumour activity is also evident using the xCELLigence device as outlined in materials and methods.

Repeat stimulation assays are performed according to materials and methods. In brief mock or CoStAR engineered cells are mixed at an 8:1 E:T ratio with OKT3 engineered target lines and the relative expansion of T-cells enumerated at the indicated time points, with fresh tumour added at seven day intervals. All CoStARs tested mediate prolonged survival and expansion of T-cells across multiple rounds of stimulation, whereas mock transduced cells decline in number following repeat stimulations.

To evaluate CoStAR activity in TIL specimens, TIL are engineered with CEA specific CoStAR constructs. To this end tumours are digested and analysed for CEA expression using flow cytometry. Tumour digests testing positive are engineered with CEA CoStARs. Following outgrowth and rapid expansion protocol, engineered and matched non-engineered TIL are mixed with either tumour digest, or where available, matched autologous tumour lines. In all donors tested the presence of the CEA CoStAR enhances specific effector activity as measured by IFNγ and IL-2 compared to cells which are mock transduced.

The impact of different MSLN specific scFv in the context of CoStAR is assessed, as well as investigating different spacer domains. Six different scFvs are compared: SS1 (Chowdhury, 1999), humanised (Hu)-SS1 (Begent et al. 2003, M5) (patent CA2931684A1), HN1 (Jackson et al. 1998), BW431/26 (Seenmann et al. 1991) and HuT84.66 (Yazaki et al. 2005Ho, 2011), M912 (Feng, 2009), HuYP218 (Zhang, 2015) and P4 (U.S. Pat. No. 9,272,002B2).

Primary human T-cells are isolated from Buffy coats obtained from the NHSBT. T-cells are isolated by Ficoll-mediated isolation and T-cell negative isolation kits (StemCell Technologies). The isolated T-cells are activated with human T-cell activation and expansion beads (Invitrogen, UK). Cells are incubated with concentrated lentiviral particles, encoding MSLN CoStARs containing the OSM SP, and expanded over a number of days. Cells are enriched for CoStAR expression using anti-CD34 antibodies to obtain T-cell populations greater than 90% CoStAR positive before being placed in a rapid expansion protocol (REP), with irradiated buffy coat derived PBMCs as outlined in the materials and methods.

A physiologically relevant in vitro model is employed to test the impact of CoStAR on T-cell activity. Transduced and non-transduced cells are tested against the MSLN+/− cell lines LoVo (MSLN−), H508 MSLN+, SW480 (MSLN+) or HT29 (MSLN+). The murine MSLN− cell line Ba/F3 is engineered to express MSLN as a control. To enable activation of the T-cells in response to the unmatched tumour lines the tumour cells are engineered to express an anti-CD3 single chain antibody fragment anchored to the cell membrane by way of a synthetic transmembrane domain and split from a GFP marker gene using an IRES element to visualise transduced cells using flow cytometry. Cell lines are also engineered to express firefly-luciferase (ffLuc) under puromycin selection to permit analysis of target cell lysis.

Non-transduced and CoStAR transduced T-cells are mixed at varying effector:target ratios with wild-type or OKT3-engineered tumour cell lines. After 24 hours coculture media is taken for IL-2 ELISA measurement. Activation dependent IL-2 secretion is observed from both CoStAR+ and CoStAR− T-cell populations from all donors in response to OKT3 engineered cells with only background IL-2 secretion seen from transduced and non-transduced T-cells in response to un-engineered tumour cells. In all donors tested, the presence of MSLN CoStAR enhances effector activity (IL2, IL3, CXCL10) towards OKT3 engineered MSLN+ tumour lines.

Cocultures with Ba/F3 cells demonstrate the targeted approach of the MSLN CoStARs. Coculture of MSLN CoStAR engineered cells with Ba/F3 or Ba/F3-MSLN does not result in specific IL2 release whereas incubation with Ba/F3-OKT3 enhances IL-2 secretion. However, incubation of T-cells with Ba/F3-OKT3/MSLN significantly enhances IL2 secretion compared to Ba/F3-OKT3 alone.

The impact of CoStAR on tumour cell killing is determined. Transduced or non-transduced T-cells are mixed with wild-type or OKT3-GFP engineered tumour cells and quantified residual tumour cell derived luciferase activity at defined time points. The presence of CoStAR enhances the ability of T-cells to mediate target cell lysis. This enhanced ability of CoStAR+ cells to mediate anti-tumour activity is also evident using the xCELLigence device as outlined in materials and methods.

Repeat stimulation assays are performed according to materials and methods. In brief mock or CoStAR engineered cells are mixed at an 8:1 E:T ratio with OKT3 engineered target lines and the relative expansion of T-cells enumerated at the indicated time points, with fresh tumour added at seven day intervals. All CoStARs tested mediate prolonged survival and expansion of T-cells across multiple rounds of stimulation, whereas mock transduced cells decline in number following repeat stimulations.

To evaluate CoStAR activity in TIL specimens, TIL are engineered with MSLN specific CoStAR constructs. To this end tumours are digested and analysed for MSLN expression using flow cytometry. Tumour digests testing positive are engineered with MSLN CoStARs. Following outgrowth and rapid expansion protocol, engineered and matched non-engineered TIL are mixed with either tumour digest, or where available, matched autologous tumour lines. In all donors tested the presence of the relevant CoStAR enhances specific effector activity as measured by IFNγ and IL-2 compared to cells which are mock transduced.

Example 8

Anti-MSLN CoStAR Expression

Anti-MSLN CoStARs comprising different scFv antigen-binding domains (Table 8) were compared for surface expression on T cells from healthy donors.

TABLE 8

| | Clone | | | | | |
|---|---|---|---|---|---|---|
| | CTP224 | CTP225 | CTP226 | CTP227 | CTP228 | CTP229 |
| SEQ ID NO: | 192 | 210 | 228 | 246 | 264 | 282 |
| Signal peptide | | | OSM1 | | | |
| scFv | SS1 | M5 | HN1 | M912 | huYP218 | P4 |
| Linker | | | AAAGSGGSG | | | |
| Spacer | | | CD28 EC | | | |
| TM | | | CD28 | | | |
| Intracellular | | | CD28.CD40 | | | |

T cells from healthy donor (HD) PBMCs were lentivirus transduced, at a multiplicity of infection (MOI) 5, with six variable scFV constructs against mesothelin (MSNL) that possessed CD28.CD40 signaling domains. Non-transduced (MOCK) cells were used as controls. Cells were sorted using CD34 microbeads and underwent a rapid expansion protocol (REP) for 14 days. Following expansion, $1 \times 10^5$ cells were assessed for transduction efficiency either via surface detection of the marker gene tCD34 or CoStAR molecule using an anti-CD34-APC (black) or anti-MSLN-PE (red) antibody, respectively. (FIG. 19). The results represent 3 biological replicates.

Example 9

Anti-MSLN CoStAR Activity

Cytokine production was assessed in CoStAR transduced HD T cells cocultured with target cell lines. A variety of CoStARs comprising different anti-MSLN binding domains, spacers, or transmembrane domains (Table 8, Table 9, Table 10) were tested.

TABLE 9

| | Clone | | | | | |
|---|---|---|---|---|---|---|
| | CTP248 | CTP249 | CTP250 | CTP251 | CTP252 | CTP253 |
| SEQ ID NO: | 300 | 306 | 312 | 318 | 324 | 330 |
| Signal peptide | OSM1 | | | | | |
| scFv | SS1 | M5 | HN1 | M912 | huYP218 | P4 |
| Linker | AAAGSGGSG | | | | | |
| Spacer | Truncated CD28 EC | | | | | |
| TM | CD28 | | | | | |
| Intracellular | CD28.CD40 | | | | | |

TABLE 10

| | Clone | | | | | |
|---|---|---|---|---|---|---|
| | CTP236 | CTP237 | CTP238 | CTP239 | CTP240 | CTP241 |
| SEQ ID NO: | 198 | 216 | 234 | 252 | 270 | 288 |
| Signal peptide | OSM1 | | | | | |
| scFv | SS1 | M5 | HN1 | M912 | huYP218 | P4 |
| Linker | AAAGSGGSG | | | | | |
| Spacer | CD8 EC | | | | | |
| TM | CD8 | | | | | |
| Intracellular | CD28.CD40 | | | | | |

Nontransduced (MOCK) and anti-MSNL CoStAR transduced HD T cells were cocultured with engineered OVCAR3 target cell lines at an effector to target (E:T) ratio of 8:1 ($1 \times 10^5 : 1.25 \times 10^4$) for 24 hours and MSD immunoassay was performed to evaluate the concentration of cytokines secreted. Cytokine concentrations were determined for IL-2 (FIG. 20A) IFNγ (FIG. 20B) and TNFα (FIG. 20C) following cocultures with OVCAR-3 or OVCAR3-OKT3 cell lines. Non-treated T cells were used as a control. The results represent 1-3 biological replicates with 3 technical replicates each.

Nontransduced (MOCK) and anti-MSNL CoStAR transduced HD T cells were cocultured with engineered K562 target cell lines at an effector to target (E:T) ratio of 8:1 ($1 \times 10^5 : 1.25 \times 10^4$) for 24 hours and MSD immunoassay was performed to evaluate the concentration of cytokines secreted. Cytokine concentrations were determined for IL-2 (FIG. 21A) IFNγ (FIG. 21B) and TNFα (FIG. 21C) following cocultures with K562-MSNL or K562-MSNL-OKT3 cell lines. Non-treated T cells were used as a control. The results represent 1-3 biological replicates with 3 technical replicates each.

Anti-CEA CoStAR Expression

Anti-CEA CoStAR expression was evaluated for anti-CEA CoStARs comprising differing signal peptides (Table 11) or scFv antigen binding domains (Table 12).

TABLE 11

| | Clone | | | | | |
|---|---|---|---|---|---|---|
| | CTP194 | CTP255 | CTP256 | CTP257 | CTP258 | CTP259 |
| SEQ ID NO: | 42 | 43 | 44 | 45 | 46 | 47 |
| Signal peptide | OSM1 | CD8 | CD2 | IL2 | GMCSF | hIgGK |
| scFv | MFE23 | | | | | |
| Linker | AAAGSGGSG | | | | | |
| Spacer | CD28 EC | | | | | |
| TM | CD28 | | | | | |
| Intracellular | CD28.CD40 | | | | | |

TABLE 12

| | Clone | | | | | |
|---|---|---|---|---|---|---|
| | CTP194 | CTP219 | CTP220 | CTP221 | CTP222 | CTP223 |
| SEQ ID NO: | 42 | 60 | 78 | 96 | 114 | 132 |
| Signal peptide | OSM1 | | | | | |
| scFv | MFE23 | MFE23 (Q > K) | hMFE23 | CEA6 | BW431/26 | hT84.66 |
| Linker | AAAGSGGSG | | | | | |
| Spacer | CD28 EC | | | | | |
| TM | CD28 | | | | | |
| Intracellular | CD28.CD40 | | | | | |

To examine signal peptide variants, T cells from healthy donor PBMCs were lentivirus transduced at a multiplicity of infection (MOI) 5, with the MFE23 scFV constructs against the carcinoembryonic antigen 5 (CEA) that possessed CD28.CD40 domains. The constructs had variations in the signal peptide and non-transduced (MOCK) cells were used as controls. Cells were sorted using CD34 microbeads and underwent a rapid expansion protocol (REP) for 14 days. Following expansion, $1 \times 10^5$ cells were assessed for transduction efficiency (FIG. 22) either via surface detection of the marker gene tCD34 or CoStAR molecule using an anti-CD34-APC (black bars) or using a primary rhCEACAM5-Fc antibody with a secondary anti-IgG-Fc-PE (grey bars) antibody, respectively.

T cells from healthy donor PBMCs were also lentivirus transduced, at a multiplicity of infection (MOI) 5, with variable scFV constructs against the carcinoembryonic antigen 5 (CEA) that possessed CD28.CD40 domains. As above, non-transduced (MOCK) cells were used as controls. Cells were sorted using CD34 microbeads and underwent a rapid expansion protocol (REP) for 14 days. Following expansion, $1 \times 10^5$ cells were assessed for transduction efficiency (FIG. 23) either via surface detection of the marker gene tCD34 or CoStAR molecule using an anti-CD34-APC (black bars) or using a primary rhCEACAM5-Fc antibody with a secondary anti-IgG-Fc-PE (grey bars) antibody, respectively.

Example 10

Anti-CEA CoStAR Activity

Cytokine production was assessed in CoStAR transduced HD T cells cocultured with Lovo target cell lines. CoStARs comprising different anti-CEA binding domains (Table 12) were tested. Nontransduced (MOCK) and anti-CEA CoStAR transduced HD T cells were cocultured with engineered target cell lines at an effector to target (E:T) ratio of 8:1 ($1 \times 10^5 : 1.25 \times 10^4$) for 24 hours and MSD immunoassay was performed to evaluate the concentration of cytokines secreted. Cytokine concentrations were determined for IL-2 (FIG. 24A) IFNγ (FIG. 24B) and TNFα (FIG. 24C) following cocultures with Lovo or Lovo-OKT3 cell lines. Non-treated T cells were used as a control. The results represent 1 biological replicate with 3 technical replicates.

Cytokine production was also assessed in CoStAR transduced HD T cells cocultured with K562 target cell lines. As above, cells were cocultured with engineered target cell lines at an effector to target (E:T) ratio of 8:1 ($1 \times 10^5 : 1.25 \times 10^4$) for 24 hours and MSD immunoassay was performed to evaluate the concentration of cytokines secreted and cytokine concentrations were determined for IL-2 (FIG. 25A) IFNγ (FIG. 25B) and TNFα (FIG. 25C) following cocultures with K562.CEACAM5 or K562.CEACAM5.OKT3 cell lines. Non-treated T cells were used as a control.

Spacer-transmembrane variants were also examined. In one experiment, anti-CEA CoStARs comprising an hMFE23 CEA-binding domain and different spacer/transmembrane domains (Table 13) were compared.

TABLE 13

| Clone | CTP220 | CTP232 | CTP244 |
|---|---|---|---|
| SEQ ID NO: | 78 | 84 | 162 |
| Signal Peptide | | OSM1 | |
| scFv | | hMFE23 | |
| linker | | AAAGSGGSG | |
| Spacer | CD28 EC | CD8 EC | CD28 (trunc IIH) |
| TM | CD28 | CD8 | CD28 |
| Intracellular | | CD28.CD40 | |

T cells from healthy donor PBMCs were lentivirus transduced at a multiplicity of infection (MOI) 5, with the hMF23 scFV constructs against the carcinoembryonic antigen 5 (CEA) that possessed CD28.CD40 domains. Cells were sorted using CD34 microbeads and underwent a rapid expansion protocol (REP) for 14 days. Following expansion, $1\times10^5$ cells were assessed for transduction efficiency (FIG. 26) via surface detection of the marker gene tCD34 using an anti-CD34-APC (black bars) or detection of the CoStAR molecule or using a primary rhCEACAM5-Fc antibody with a secondary anti-IgG-Fc-PE (grey bars) antibody. All variants were efficiently expressed.

Cytokine production was assessed in CoStAR transduced HD T cells cocultured with Lovo target cell lines. As above, cells were cocultured with engineered target cell lines at an effector to target (E:T) ratio of 8:1 ($1\times10^5$:$1.25\times10^4$) for 24 hours and MSD immunoassay was performed to evaluate the concentration of cytokines secreted and cytokine concentrations were determined for IL-2 (FIG. 27A) IFNγ (FIG. 27B) and TNFα (FIG. 27C) following cocultures with Lovo or Lovo-OKT3 cell lines. Non-treated T cells were used as a control.

Example 11

CoStARs were constructed to test intracellular signaling domains. FIG. 28 and Table 14 depict anti-CEA CoStARs comprising an hMFE23 CEA-binding domain with intracellular signaling domains comprising CD40, CD134, CD137, CD2, ICOS, DAP10, and NTRK1 signaling elements.

TABLE 14

| | Clone | | | | |
|---|---|---|---|---|---|
| | CTP313 | CTP314 | CTP315 | CTP316 | CTP317 |
| SEQ ID NO: | 344 | 345 | 346 | 347 | 348 |
| Signal peptide | | | OSM1 | | |
| scFv | | | hMFE23 | | |
| Linker | | | AAAGSGGSG | | |
| Spacer | | CD28 EC | | | ICOS |
| TM | | CD28 | | | ICOS |
| Intracellular | NTRK1 | NTRK1 | CD28 | CD28 | ICOS |
| | | CD40 | NTRK1 | NTRK1 | CD40 |
| | | | | CD40 | |

TABLE 14-continued

| | Clone | | | | |
|---|---|---|---|---|---|
| | CTP318 | CTP319 | CTP320 | CTP321 | CTP322 | CTP323 |
| SEQ ID NO: | 349 | 350 | 351 | 352 | 353 | 354 |
| Signal peptide | | | OSM1 | | | |
| scFv | | | hMFE23 | | | |
| Linker | | | AAAGSGGSG | | | |
| Spacer | CD28 EC | | CD2 EC | CD28 EC | | |
| TM | CD28 | | CD2 | CD28 | | |
| Intracellular | CD28 | CD28 | CD2 | CD28 | CD28 | CD28 |
| | ICOS | ICOS | CD40 | CD2 | CD40 | CD137 |
| | | CD40 | | | CD2 | |

| | Clone | | | | |
|---|---|---|---|---|---|
| | CTP324 | CTP325 | CTP326 | CTP327 | CTP328 |
| SEQ ID NO: | 355 | 356 | 357 | 358 | 359 |
| Signal peptide | | | OSM1 | | |
| scFv | | | hMFE23 | | |
| Linker | | | AAAGSGGSG | | |
| Spacer | | | CD28 EC | | |
| TM | | | CD28 | | |
| Intracellular | CD28 | CD28 | CD28 | CD28 | CD28 |
| | CD40 | DAP10 | CD40 | CD 134 | CD40 |
| | CD137 | | DAP10 | | CD 134 |

T cells from healthy donor PBMCs were lentivirus transduced at a multiplicity of infection (MOI) 5 with the hMF23 scFV constructs against the carcinoembryonic antigen 5 (CEA). Nontransduced (MOCK) cells were used as controls. Cells were sorted using CD34 microbeads and underwent a rapid expansion protocol (REP) for 14 days. Following expansion, $1\times10^5$ cells were assessed for transduction efficiency (FIG. 29) either via surface detection of the marker gene tCD34 or CoStAR molecule using an anti-CD34-APC (black) or using a primary rhCEACAM5-Fc antibody with a secondary anti-IgG-Fc-PE (red) antibody, respectively. The results represent 3 biological replicates.

CoStAR transduced cells were phenotypically characterized. Following outgrowth and REP, $1\times10^5$ cells were assessed for the differentiation subtype using flow cytometry.

TABLE 15

| T Cell Differentiation Subtype Definition | | | |
|---|---|---|---|
| TN | CD45RO− | CCR7+ | CD95− |
| Tscm | CD45RO− | CCR7+ | CD95+ |
| Tcm | CD45RO+ | CCR7+ | CD95+ |
| Tem | CD45RO+ | CCR7− | CD95+ |
| Tte | CD45RO− | CCR7− | CD95+ |

Tcm, central memory T cell;
Tem, effector memory T cell;
Tn, naive T cell;
Tscm; stem cell memory T cell;
Tte, terminal effector T cell T cells from HD PBMCs of three donors were lentivirus transduced with the hMF23 scFV constructs of FIG. 28. Cells were sorted using CD34 microbeads and underwent a rapid expansion protocol (REP) for 14 days. Following outgrowth and REP, $1\times10^5$ cells were assessed for the differentiation subtype compared to non-transduced cells using flow cytometry. T cell phenotypes are depicted in FIG. 30 as a proportion of CD3 cells.

Example 12

Cytokine secretion anti-CEA hFME23 CoStAR transduced T cells was assessed by coculture with K562 target cells. Nontransduced (MOCK) and anti-CEA CoStAR transduced HD T cells were cocultured with engineered target cell lines at an effector to target (E:T) ratio of 8:1 ($1\times10^5$:$1.25\times10^4$) for 24 hours and MSD immunoassay was performed to evaluate the concentration of cytokines secreted. Cytokine concentrations for IL-2 (FIG. 31A) IFNγ (FIG. 31B) and TNFα (FIG. 31C), following cocultures with K562.CEACAM5 (signal 2) or K562.CEACAM5.OKT3 (signal 1+2) cell lines are shown. Non-treated T cells were used as a control.

Cytokine expression was also assessed. Nontransduced (MOCK) and anti-CEA CoStAR transduced HD T cells were cocultured with engineered target cell lines at an effector to target (E:T) ratio of 1:1 ($1\times10^5$:$1\times10^5$) for 16 hours in the presence of Brefeldin A and cytokine producing cells were measured using intracellular flow cytometry. Frequency of IL-2 (FIG. 32A) IFNγ (FIG. 32B) and TNFα (FIG. 32C) expressing cells following cocultures with K562.CEACAM5 (signal 2) or K562.CEACAM5.OKT3 (signal 1+2) cell lines are shown. Non-treated T cells were used as a control.

Example 13

Proliferation of Anti-CEA CoStAR Transduced Cells

HD T cells were transduced with hMFE23 anti-CEA CoStARs and cocultured with engineered target cells. Nontransduced (MOCK) and anti-CEA CoStAR transduced HD T cells were cocultured with K562.CEACAM5.OKT3 engineered target cell lines at an effector to target (E:T) ratio of 8:1 ($1\times10^5$:$1.25\times10^4$) on Day 0. Nontransduced (MOCK) cells were used as controls. On Day 7, a maximum 50000 cells were re-stimulated with K562.CEACAM5.OKT3 engineered target cell lines at an E:T of 8:1. On Day 5, Day 7 and Day 9 post stimulation a portion of the cocultures were collected for counting by flow cytometry. For all counts, DRAQ7 was used for live cell discrimination and CD2 to enumerate the T cells (FIG. 33). The figures represent fold expansion of input cells. N=2

HD T cells transduced with hMFE23 anti-CEA CoStARs and cocultured with K562.CEACAM5.OKT3 engineered target cell lines as above were sampled for counting on Day 6 to evaluate fold expansion (FIG. 34). Cells were counted by flow cytometry using DRAQ7 for live cell discrimination and CD2 to enumerate the T cells.

Example 14

Signal Transduction and Intracellular Domain Binding Sites and Motifs.

The effect of mutations in TRAF2/TRAF3 and TRAF6 binding sites (FIG. 35) of CD40 on cytokine secretion and long term survival and proliferation of CD28.CD40 CoStAR transduced T cells was examined. Cells of three donors were activated with Dynabeads and transduced with WT CD28.CD40 (CTP194), CD28.CD40 containing TRAF2 binding site mutation SVQE>AVQA (CTP195), TRAF2/TRAF3 binding site mutation PVQET>AVAEA (CTP196), TRAF6 binding site mutation PQEINF>AQAINF (CTP197), Q263A (CTP199), or mock transduced. Cells were enriched for CD34 marker expression, expanded following the rapid expansion protocol (REP) and frozen for subsequent experiments. After thaw, cells were rested for 3-4 days in complete RPMI supplemented with IL-2 and their transduction rate was determined looking at the CD34 marker gene expression. The viability and absolute count were assessed after overnight IL-2 starvation using DRAQ-7 (1:200) by flow cytometry (Novocyte) and data were analysed using the NovoExpress 1.5.0 software. Transduced T cells were cocultured in absence of IL-2 with LoVo (CCL-229™ from ATCC) or LoVo.OKT3.GFP tumor cells at 8:1 effector to target ratio. After 24 hours, supernatants were collected and frozen. LoVo and LoVo.OKT3.GFP naturally express CEA and PD-L1 on their surface, conferring signal 2 through the CoStAR alone (LoVo) or associated with signal 1 (LoVo.OKT3.GFP) to the transduced T cells. Cocultures were performed in triplicates and corresponding negative (T cells alone, tumor cells alone) and positive (PMA+ionomycin) controls were included in the experiment. After thaw, secreted IL-2 was detected by ELISA and the absorbance was measured using the FLUOstar Omega microplate reader and subsequently analysed with the Omega MARS 3.42 R5 software (FIG. 36A). Each dot represents the mean of triplicates for one donor. Note that negative controls (T cells alone, tumor cells alone) were all below the detection range.

After 6-8 days, the viability and absolute count were assessed, and live T cells were rechallenged for an additional week with fresh LoVo.OKT3.GFP tumor cells as described above. At the end of the long-term coculture, the viability and absolute count were measured, and the fold expansion was calculated (FIG. 36B). Data shown as mean+/−SEM of n≤3 donors analysed in triplicates.

Mutation of the TRAF2 binding site (SVQE>AVQA; CTP195) resulted little reduction in IL-2 secretion and moderate reduction of expansion. Mutation of the TRAF2/TRAF3 binding site (PVQET>AVAEA; CTP196) resulted in substantial reduction in IL-2 secretion and expansion. Mutation of the TRAF6 binding site (PQEINF>AQAINF; CTP197) resulted in moderate reduction in IL-2 secretion and moderate reduction of expansion.

Example 15

Non-transduced (Non-Td) and anti-FOLR1 CoStAR transduced (Td) TILs were generated using a 24-day protocol. Briefly, aliquots of OC digest were thawed and transduced with anti-FOLR1 CoStAR lentivirus at a multiplicity of infection (MOI) of 5 at 48 h and 72 h. Cells were then expanded for 8 days (outgrowth), and then subjected to a rapid expansion protocol (REP) with allogeneic irradiated peripheral blood mononuclear cells (PBMCs) for 12 days.

After production, TIL CD4/CD8 ratio and anti-FOLR1 CoStAR transduction efficiency was measured. TILs were phenotypically characterized for their differentiation status, expression of co-inhibitory and co-stimulatory markers, T cell subsets and cytokine producing potential using flow cytometric panels.

Complete TIL T cell media (TCM) for outgrowth consists of 450 mL of GIBCO custom P158718 media with 50 mL of heat inactivated Fetal Bovine Serum, gentamycin (10 μg/mL)/amphotericin (0.25 μg/mL) and vancomycin (50 μg/mL). Complete rapid expansion protocol (REP) media consists of 460 mL of GIBCO custom P158718 with 40 mL human AB serum, gentamycin (10 μg/mL)/amphotericin (0.25 μg/mL) and vancomycin (50 μg/mL).

Generation of Anti-FOLR1 CoStAR OC TILs

Five OC samples were used to generate anti-FOLR1 CoStAR modified TILs. The outgrowth period of TILs was 12 days. On day 1 (D1), samples from each donor were thawed in complete TIL TCM, the cells were washed once by centrifuging at 400×g for 5 minutes, resuspended in fresh TIL TCM and counted. All cell counts were performed using a DRAQ7 dye and anti-CD2 antibody stains using a Novocyte 3005 Flow Cytometer System. TILs were then centrifuged at 400×g for 5 minutes, resuspended at a concentration of 1×10⁶ cells/mL, placed into an appropriate vessel with 3000 IU/mL IL-2 and rested for two days in a 5% CO2 incubator set to 37° C.

Following the rest period on day 3, cells were collected, washed, centrifuged at 400×g for 5 minutes, and resuspended in fresh complete TCM. The number of viable cells in each sample was determined using a Novocyte 3005 as described above, cells were centrifuged at 400×g for 5 minutes and resuspended at a concentration of 1×10⁶ cells/mL. Each sample was split into two equal parts, one for production of Non-Td and other for transduced (Td) TIL, modified to express anti-FOLR1 CoStAR. Transduction with anti-FOLR1 CoStAR lentivirus was performed at an MOI of 5 based on the total number of live cells. IL-2 was added at a concentration of 3000 IU/mL and the cells were placed in a 5% CO2 incubator set to 37° C.

On day 4, the cells were collected, washed once with complete TIL TCM, and resuspended in the same volume of fresh complete TIL TCM as on day 3 for the second day of transduction. Transduction was performed using the anti-FOLR1 CoStAR lentivirus at an MOI of 5 and IL-2 at 3000 IU/mL was added to the cells prior to placing them in a 5% CO2 incubator set to 37° C. for 8 days. IL-2 (3000 IU/mL) was added to the cells every 2-3 days until D13.

On day 13 cells were collected, washed, resuspended in complete TIL TCM and counted using a Novocyte 3005. After determining the TIL numbers on day 13, the cells were seeded in appropriate scale G-REX plates for REP using 10 healthy donors worth of irradiated allogeneic PBMCs as feeders at a 200:1 ratio of feeders:TIL. The media used for the REP was the complete REP TIL TCM with anti-CD3 (OKT3) antibody was added at a concentration of 30 ng/mL for activation. IL-2 was added at a concentration of 3000 IU/mL and the cells were placed in a 5% CO2 incubator set to 37° C. The REP period was 12 days during which IL-2 (3000 IU/mL) was supplemented every 2-3 days.

On day 19 (ie, day 6 of REP), 5 mL of medium from the 24 well G-REX plates or 25 mL of medium from the 6 well G-REX plates was removed without disturbing the cells and replaced with fresh complete REP TIL TCM and IL-2 (3000 IU/mL). On D25, at the end of the REP, TILs were harvested by centrifugation at 400×g for 5 minutes and resuspended in fresh media for counting using a Novocyte 3005. TILs were resuspended at a concentration of 1×10⁶ cells/mL. TILs were then assessed for transduction efficiency by staining 1×10⁵ cells of each sample with antibodies against CD3, CD4, CD8, CoStAR and a viability stain. DNA was extracted from 1×10⁶ cells from each sample using the DNeasy Blood & Tissue Kit following the manufacturer's instructions. Isolated DNA was used to analyze the vector copy number (VCN) using Droplet Digital PCR (ddPCR) and primers specific to the anti-FOLR1 CoStAR and the reference gene Poly(rC) binding protein 2 (PCBP2). For subsequent experiments 2-5×10⁷ cells were rested in fresh complete REP TIL TCM for 3 days with IL-2 (3000 IU/mL). Remaining TIL were resuspended in cryoprotectant and aliquoted to cryovials, cooled to −80° C. overnight, and then transferred to −150° C. for short term storage. Cryopreserved TIL were thawed in a 37° C. water bath, washed once with PBS by centrifugation at 400×g for 5 minutes, then underwent an identical rest period as described above prior to experimentation.

Phenotypic Characterization of Anti-FOLR1 CoStAR OC TILs from Four Donors.

Non-Td and Td cells from four donors were rested for 3 days in REP TCM media with IL-2 (3000 IU/mL). Subsequently, the cells were harvested, washed once with media by centrifugation at 400×g for 5 minutes, resuspended in fresh complete REP TIL TCM, counted using Novocyte 3005, and resuspended at a concentration of 1×10⁶ cells/mL. Cytometric evaluation of TILs was performed on 1×10⁵ cells per well, in triplicates, using four flow cytometry panels. Assessment of differentiation status was performed using a panel with antibodies against CD3, CD4, CD8, CD27, CD95, CCR7, CD45RA, CD45RO, CoStAR, and a viability stain. Coinhibitory and costimulatory marker expression was assessed using antibodies against CD4, CD8, CD137, programmed cell death protein 1 (PD-1), cytotoxic T-lymphocyte-associated protein 4 (CTLA-4), lymphocyte-activation gene 3 (LAG-3), T cell immunoglobulin and mucin domain protein 3 (TIM-3), signaling lymphocyte activation molecule (SLAM), CoStAR, and a viability stain. Cell subpopulations, including Tregs, were assessed using antibodies against CD3, CD4, CD25, forkhead box Protein 3 (FOXP3), T cell receptor alpha beta (TCRαβ), T cell receptor gamma delta (TCRγδ), CD56, CD127, CoStAR, and a viability stain. Cytokine production upon mitogenic stimulation was assessed using antibodies against CD3, CD4, CD8, IL-22, TNFα, IL-17A, IFNγ, CoStAR, and a viability stain. For this panel, TILs were activated by addition of PMA (50 ng/mL)/ionomycin (1 µg/mL), and Brefeldin A (1000×) and placed in a 5% CO2 incubator set to 37° C. for four hours. Following activation, TILs were collected, centrifuged at 400×g for 5 minutes, counted, and 1×10⁵ cells were seeded in triplicate for cytometric analysis. For all flow cytometry panels, fixation and permeabilization was performed using BD Cytofix/Cytoperm per manufacturer's instructions. Following staining, cells were washed and resuspended in PEF (500 mL DPBS, 2 mL EDTA and 2.5 mL of heat inactivated FBS) for analysis using a Novocyte 3005 Flow Cytometer System.

Analysis of the Non-Td and Td Cells

For the four panels of phenotypic characterization, recombinant human FOLR1 with Fc tag (rhFOLR1-FC) was used for the detection of anti-FOLR1 CoStAR cells, and the populations of interest were reported from CoStAR− subset for the Non-Td TILs, and both CoStAR− and CoStAR+ fractions from the Td TILs (anti-FOLR1 CoStAR− Td TILs and anti-FOLR1 CoStAR+Td TILs). Further subset characterization was performed on these populations.

Differentiation Status

The gating strategy employed for characterizing T cell differentiation status was as follows: a lymphocyte gate followed by doublet and dead cell exclusion, CD3+, CD4+ and CD8+ gates. From all three populations (CD3+, CD4+, and CD8+), further analysis was performed on the T cell fractions of interest. To characterize the different T cell memory subsets, CD45RA+CD45RO− and CD45RA−CD45RO+ cells were gated from CD3+ cells. CD45RO+ CCR7+ and CD45RO+ CCR7− populations were then gated from CD45RA−CD45RO+ cells. Using these gates, the central memory T cells (Tcm; CD45RO+ CCR7+CD95+ CD27+) cells and effector memory T cells (Tem; CD45RO+ CCR7−CD95+CD27+/−) cells were further gated. Additionally, CD45RA+ CCR7+ and CD45RA+ CCR7− populations were gated from CD45RA+CD45RO− cells. Using these gates, stem cell memory T cells (Tscm; CD45RA+ CCR7+ CD95+CD27+) and naïve T cells (Tn; CD45RA+ CCR7+ CD95−CD27+) were gated from CD45RA+ CCR7+ cells, whilst terminal effector T cells (Tte; (CD45RA+ CCR7− CD27−CD95+) cells were gated from CD45RA+ CCR7− cells.

counted using flow cytometry where the average percentage of CD2+ TILs was 19.5±9.43. The total TILs harvested in the thawed samples ranged between $4.4 \times 10^5$-$3.3 \times 10^6$ cells.

TABLE 16

Ovarian tumor sample information

| ID | Tumor type/ Histology | Tumor weight | Markers | Clinical stage | TNM | Grade | Treatment status |
|---|---|---|---|---|---|---|---|
| 1 | Ovarian Cancer/ Serous cystadenocarcinoma-M-84413 | 2.62 | CA125-937 | IB | T1b - N0-M0 | G2—Moderately differentiated | Treatment—naive |
| 2. | Ovarian Cancer/ Serous cystadenocarcinoma-M-84413 | 0.55 | CA125-478,83 | IV | T3-Nx-M' | G3—Poorly differentiated | Treatment—naive |
| | Ovarian Cancer/Serous cystadenocarcinoma-M-84413 | 4.2 | CA125-50,53 | IIB | T2b-Nx-MO | G3—Poorly differentiated | Treatment—naive |
| 4 | Ovarian Cancer/ Endometrioid carcinoma-M-83803 | 2.1 | CA125-1096 HE4-1487 | IC | T1c-Nx-MO | G2—Moderately differentiated | Treatment—naive |
| | Ovarian Cancer/ Clear cell adenocarcinoma-M-83103 | 2.5 | CA125-187 | IIIC | T3c-NX-Mo | G3—Poorly differentiated | Treatment—naive |

Abbreviations:
ID, identification;
CA125, cancer antigen 125;
TNM, tumor, nodes, metastases.

Coinhibitory and Costimulatory Markers

The gating strategy employed for characterizing coinhibitory and costimulatory molecules included doublet and dead cell exclusion. Gating of CD4+ and CD8+ and CoStAR+/− cells was performed and populations were further analyzed for CD137, PD-1, CTLA-4, LAG-3, TIM-3 and SLAM expression.

T Cell Subtype

The gating strategy employed for characterizing T cell subtypes included doublet and dead cell exclusion and a CD3+ gate. Using these populations, the expression of TCRαβ, TCRγδ, and CD56 was assessed. Subsequently, the CD3+CD4+ cells were gated for expression of TCRaP and CD56, and further analysis of the CD3+CD4+TCRαβ+ population for CD25 and CD127 expression was performed. Using the CD25+CD127− gate the FOXP3+ cells were gated to determine the population of Tregs. Therefore, Tregs are defined as CD3+TCRab+CD4+CD25+CD127-FOXP3+ and CoStAR+/−depending on the population assessed.

Cytokine Production Upon Mitogenic Stimulation

The gating strategy employed for characterizing intracellular cytokine production included doublet and dead cell exclusion, CD3+, CD4+, and CD8+ gates. CoStAR expression analysis on the different populations was performed followed by further analysis of the frequency of cells expressing IL-22, IL-17A, TNFα, and IFNγ.

Clinical Characteristics

Figure 39A:
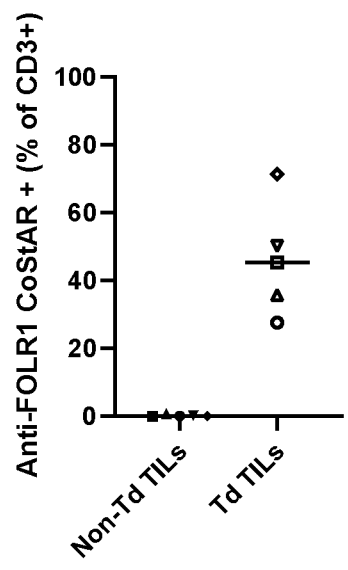
Figure 39B:
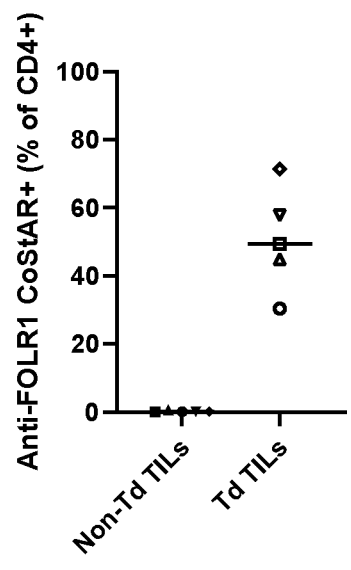
Figure 39C:
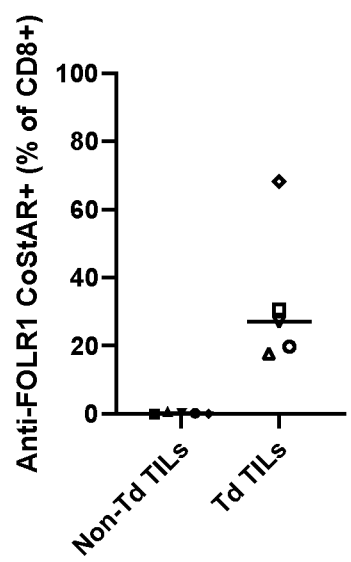
Figure 39D:
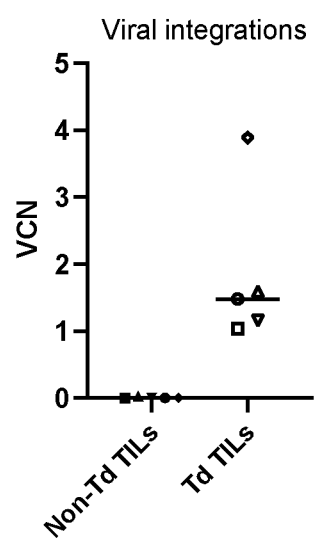

Clinical characteristics of TILs from five ovarian cancer patients are shown in Table 16. Patients were all treatment naïve, and the specific histology revealed three serous cystadenocarcinomas, one endometrioid, and one clear cell adenocarcinoma. Sample weights ranged between 0.55-2.62 grams with a mean weight of 2.39±1.31 grams. After processing, samples were cryopreserved at $6 \times 10^6$-$2.5 \times 10^7$ cells in 1 mL per vial. On day 1, samples were thawed and After TIL production, cell numbers of Non-Td and Td TILs were compared to assess any effect of anti-FOLR1 CoStAR modification on TIL growth. Results showed no significant impact on the cell numbers of TILs (FIG. 38). Proportions of transduced CD3+, CD4+ and CD8+ cells were assessed after TIL production (FIG. 39A-C). CD4 cells showed higher transduction percentage (50.8±15.2%) than the CD8 cells (32.7±20.6%), and this was statistically significant (p=0.384). Additionally, VCN was assessed using ddPCR to detect the CoStAR transgene relative to the PCBP2 reference gene and <4 integrations per cell were measured (FIG. 39). Comparison of the CD4 and CD8 population composition in the product indicated most cells were CD4+ with levels ranging between 53.0-58.7% and fewer CD8+ cells (30.8-38.2%). CD4+CD8+ and CD4− CD8− cells were also detected at low levels ranging between 3.47-4.43% and 3.19-6.97%, respectively. There were no significant differences between the Non-Td, anti-FOLR1 CoStAR-Td, and anti-FOLR1 CoStAR+Td TILs with regards to the CD4/CD8 cell composition (FIG. 40).

The TILs were further characterized to determine whether anti-FOLR1 CoStAR modification impacted TIL function. The composition of Tn, Tscm, Tcm, Tem and Tte were assessed from CD3+, CD4+ and CD8+ T cell compartments of Non-Td, anti-FOLR1 CoStAR− Td and anti-FOLR1 CoStAR+Td TILs (FIG. 41A-C). Results show that majority of TILs were Tem across the CD3+(63.2-78.6%), CD4+ (76.9-88.8%) and CD8+(48.3-66.9%) populations. Tcm cell frequencies were between 6.28-15.7%, 6.72-17.5% and 5.18-11.7% for CD3+, CD4+ and CD8+ TILs, respectively. Tte cells made up 14.8-15.9% of bulk CD3+ TILs. These were mainly in the CD8+ subpopulation with frequencies of 22.1-25.1% versus 2.68-3.79% in the CD4+ subpopulation. Few Tscm cells were detected for CD3+, CD4+ and CD8+ TILs with frequencies of 0.15-1.38%, 0.05-0.50% and 0.53-

3.24%, respectively. The lowest frequency memory subtype were the Tn cells, and these ranged between 0.002-0.019% across all three populations. There were no significant differences between the Non-Td, anti-FOLR1 CoStAR– Td and anti-FOLR1 CoStAR+Td TILs with regards to Tn, Tem, Tcm or Tte frequencies. Despite the low Tscm TILs, significantly lower Tscm TILs were detected in the anti-FOLR1+Td TILs in CD3+(0.15±0.05% vs 1.38±0.69%) and CD4+(0.05±0.02% vs 0.51±0.27%) populations compared to the anti-FOLR1-Td TILs, but not the Non-Td TILs. Overall, the data shows that anti-FOLR1 CoStAR modification did not significantly affect differentiation status of TILs.

CD8+ and CD4+ TILs were assessed for the expression of CD137, PD-1, CTLA-4, LAG-3, TIM-3 and SLAM (FIG. 42). In CD4+ TILs, expression for all three populations of interest were in the range of 39.8-47.7%, 61.0-64.4%, 52.7-57.6, and 65.6-72.1% for LAG-3, PD-1, SLAM, and TIM-3, respectively. In CD8+ TILs, expression ranged between 86.7-88.2%, 38.2-46.5%, 61.5-67.2%, and 90.0-94.3% for LAG-3, PD-1, SLAM, and TIM-3, respectively. CTLA-4 ranged between 8.92-15.2% and 4.10-7.29%, and CD137 was 2.80-8.30% and 7.70-17.1%, for CD4+ and CD8+ cells, respectively.

Comparison of the three TIL populations, Non-Td, anti-FOLR1 CoStAR– Td and anti-FOLR1 CoStAR+Td TILs, indicated that there was no effect of the anti-FOLR1 CoStAR on coinhibitory and costimulatory marker expression in CD4+ TILs. In CD8+ TILs, CD137+(17.1±8.79% vs 7.70±3.92% vs 7.77±4.01%) and CTLA-4+(7.29±2.41% vs 4.66±1.51% vs 4.10±1.07%) cells were of higher frequency in anti-FOLR1+Td when compared to both the non-Td and anti-FOLR1 CoStAR– Td TILs. PD-1+TIL frequency was only higher in comparison to the anti-FOLR1-Td TILs but not the Non-Td TILs (46.5±21.1% vs 38.2±19.6% vs 40.6±26.8%, respectively). Overall, there was little observed effect of CoStAR modification of TILs for coinhibitory or costimulatory marker expression except for the slight but significant increase in the frequency of CD8+CD137+, CTLA4+, and PD-1+ TILs.

T cell subset frequency was assessed in TIL samples, using markers for Treg detection in addition to the expression of TCRαβ and TCRγδ. The majority of the CD3+ cells expressed TCRαβ (90.0-93.5%) with relatively few TCRγδ cells (1.35-3.08%) detected (FIG. 43A) and no differences were observed between the three populations. The percentage of Tregs (CD3+TCRαβ+CD4+CD25+CD127-FOXP3+) either in the CoStAR– or CoStAR+ TILs was very low. Specifically, the detection frequencies were 0.63±0.48%, 0.66±0.36% and 0.93±0.63% for non-Td, anti-FOLR1 CoStAR– and anti-FOLR1 CoStAR+Td TILs, respectively (FIG. 43B). Overall, there was no effect of anti-FOLR1 CoStAR on TCRαβ, TCRγδ, and Treg frequencies when comparing the Non-Td, anti-FOLR1 CoStAR– Td and anti-FOLR1 CoStAR+Td TILs.

TILs were assessed the ability of the cells to produce cytokines upon mitogenic activation using PMA/ionomycin. The Non-Td and Td TILs were activated for 4 hours using PMA/ionomycin and then stained for IFNγ, IL-22, IL-17A, and TNFα from CD3+, CD4+, and CD8+ cells. Upon stimulation, high frequencies of CD3+ TILs expressing TNFα (61.8-73-6%) and IFNγ (32.5-42.0%), and lower frequencies of IL-22 (4.74-8.07%) and IL-17A (5.74-11.0%) expressing cells were detected (FIG. 44A). The frequency of TNFα+ cells was higher in anti-FOLR1 CoStAR+Td compared to anti-FOLR1 CoStAR– Td TILs (73.6±14% vs 61.8±18.3%), but not Non-Td TILs (72.1±9.20%).

In CD4+ TILs, high frequencies of cells expressing TNFα (54.3-67.2%), and lower frequencies of IFNγ (19.3-26.2%), IL-22 (7.63-10.5%) and IL-17A (12.0-20.2%) expressing cells were detected (FIG. 44B). The frequencies of TNFα+ (67.2±15.5% vs 54.3±17.2%) and IL-17A+ cells (20.2±11.3 vs 12.0±7.06) were higher in anti-FOLR1 CoStAR+Td relative to anti-FOLR1 CoStAR– Td TILs. No significant differences were observed in the frequency of CD4+ expressing TNFα or IL-17A when comparing either anti-FOLR1 CoStAR+/–Td TILs to Non-Td TILs.

Similar observations were made for the CD8+ TIL population, where high TNFα (62.7-86.7%) and IFNγ (45.3-63.0%), and lower IL-22 (6.80-17.0%) and IL-17A (6.93-15.3%) frequencies of positive cells were detected (FIG. 44C). In this population, higher frequencies of cytokines expressing cells were identified in the anti-FOLR1 CoStAR+Td TILs compared to anti-FOLR1 CoStAR– TILs with regards to TNFα (86.7±8.37% vs 62.7±18.2%), IL-17A (15.3±7.24% vs 6.93±2.77%), and IL-22 (17.0±6.90% vs 6.80±2.48%). Again, no significant differences were observed between either anti-FOLR1 CoStAR+/–Td TILs compared to Non-Td TILS.

The significant differences observed both in the CD4+ and CD8+ subpopulations between the IL-17A+ anti-FOLR1 CoStAR+Td TILs and anti-FOLR1 CoStAR-Td TILs were not statistically significant in the CD3+ bulk population (p=0.0527). Collectively, some statistically significant differences were observed within CD3+, CD4+, or CD8+ TIL populations in the proportion of IL-17A, IL-22, and TNFα expressing cells between anti-FOLR1 CoStAR+/– populations of Td cells. However, no significant differences were observed in the frequency of IFNγ, IL-17A, IL-22, and TNFα producing cells when comparing either Td population (ie, anti-FOLR1 CostAR–/+ fractions) to Non-Td TILs.

Example 16

Antitumor Reactivity of CoStAR Positive TILs

Complete rapid expansion protocol (REP) medium consisted of 460 mL GIBCO custom P158718 supplemented with 40 mL human AB serum, gentamycin (10 µg/mL)/ amphotericin (0.25 µg/mL) and vancomycin (50 µg/mL). Complete T cell medium (TCM) consisted of 450 mL RPMI 1640 GlutaMAX™ Supplement HEPES medium supplemented with 5 mL Penicillin-Streptomycin, 500 µL 2-Mercaptoethanol (50 mM), and 50 mL Fetal Bovine Serum (FBS).

Preparation of CoStAR Modified OC TILs for Functional Characterization

Non-Td and Td TILs from five OC samples were produced as described in ITIL-306-NC-010 and the transduction percentages are shown in Table 2.

TABLE 17

| | Non-Td and Td TIL donors | | |
|---|---|---|---|
| Donor | CoStAR % of CD3 in Non-Td | CoStAR % of CD3 in Td | Symbol |
| 1 | 0.98 | 34.00 | ■ |
| 2 | 0.11 | 24.33 | ● |
| 3 | 0.20 | 47.11 | ▼ |
| 4 | 0.09 | 45.65 | ▲ |
| 5 | 0.15 | 64.60 | ♦ |

TILs were either used directly after the REP or upon thaw from long-term cryopreservation (−150° C.; stored in cryoprotectant consisting of FBS with 10% DMSO). ovarian cancer TILs were thawed using a 37° C. water bath, transferred to a 50 mL Falcon tube with 10 mL of complete REP TCM, centrifuged at 400×g for 5 minutes and resuspended in complete REP TCM. Both post-REP and post-thaw TILs, were counted using the NovoCyte 3005 Flow Cytometer System following DRAQ7 dead cell exclusion and a CD2+ count and placed in T75 flasks at a density of $1\times10^6$ cells/mL in complete REP TCM supplemented with 3000 IU/ml of interleukin 2 (IL-2). The cells were then placed in a 5% CO2 incubator set to 37° C. for 2-3-days. Before the assay, TILs were resuspended in complete REP TCM at a density of $1\times10^6$ cells/mL without IL-2 and placed in a 5% CO2 incubator set to 37° C. overnight.

Assessment of FOLR1 Expression by Autologous Tumor Digest.

All autologous tumor digests were thawed from long-term cryopreservation (−150° C.; stored in cryoprotectant consisting of FBS with 10% DMSO) using a 37° C. water bath, transferred to a 15 mL Falcon tube with 9 mL of complete TCM, centrifuged at 400×g for 5 minutes and resuspended in 5 mL of complete TCM. The number of viable cells in each sample was determined using the NovoCyte 3005 Flow Cytometer System following DRAQ7 dead cell exclusion, and the cells were resuspended at a concentration of $1\times10^6$ cells/mL in completed TCM. $1\times10^5$ autologous tumor digest cells were then analyzed according to the flow cytometry staining protocol and acquired using the Novocyte 3005 Flow Cytometer System.

The quantification of FOLR1 expression was conducted according to the following gating strategy: a cell gate (forward scatter-height [FSC]-H vs side scatter-height [SSC]-H), then a doublet exclusion gate (SSC-H vs side scatter-area [SSC-A]) followed by a dead cell exclusion gate (SSC-A vs Fixable Viability dye eFluor 450). The CD2-cells were then gated from which the frequency of the FOLR1+ cells were quantified (SSC-A vs FOLR1-PE).

Cytokine Production Assessed by Intracellular Flow Cytometry

To measure the frequencies of cytokine producing T cells, Non-Td and anti-FOLR1 CoStAR Td TILs were cocultured at a 1:1 effector to target ratio (E:T, $1\times10^5$ TILs:$1\times10^5$ target cells) with either autologous tumor digests, K-562, or OVCAR-3 derived engineered cell lines as targets. Cocultures took place in 96 well round bottom plates with 200 μL complete TCM supplemented with 1× Brefeldin A and were incubated in a 5% CO2 incubator set to 37° C. for 16 hours. Unstimulated TILs or target cells alone were used as negative controls, and positive control TILs were activated with 50 ng/mL phorbol-myristate-acetate (PMA) and 1 μg/mL ionomycin. All conditions were performed in triplicates.

Measurement of cytokine production was performed using a panel with antibodies against CD3, CD4, CD8, CoStAR (anti-idiotype 19.1 primary and anti-mouse IgG1 secondary antibodies), tumor necrosis factor alpha (TNFα), IL-2, and a viability stain. Following the 16-hour incubation, cocultures were harvested by centrifugation at 500×g for 4 minutes. The supernatant was discarded, and samples were analyzed by flow cytometry. Briefly, cells were labelled using 100 μl of fixable viability dye (1:1000 diluted in PBS) and incubated for 10 minutes at room temperature. Subsequently, cells were washed using BD stain buffer, centrifuged at 500×g for 4 minutes, and cell pellets were resuspended in 100 μl of BD stain buffer with FcR blocking reagent for 10 minutes at room temperature. Following the incubation step, cells were washed once with BD stain buffer and fixed using 4% paraformaldehyde (PFA) for 15 minutes at room temperature. A wash with BD perm/wash buffer, staining using the 19.1 anti-idiotype for 25 minutes at 4° C. and two more BD perm/wash buffer washes followed. Cells were then resuspended in 100 μl of BD stain buffer with CD3, CD4, CD8, anti-mouse IgG1, TNFα, and IL-2 and incubated at 4° C. for 25 minutes. Following two more wash steps using BD perm/wash buffer, cell pellets were resuspended in 100 μl of BD stain buffer for acquisition on NovoCyte 3005 Flow Cytometer System.

The quantification of TNFα and IL-2 producing cell frequencies in the CD4 and CD8 subpopulations was conducted according to a gating strategy that included dead cell exclusion. CD3+ cells were gated from the live gate (SSC-A vs CD3-A) and then CD4+ and CD8+ cells were gated from the CD3+ gate (CD4-A vs CD8-A). TNFα and IL-2 producing cells were reported from the CoStAR negative (−) subset for the Non-Td TILs, and both CoStAR− and CoStAR positive (+) fractions from the Td TILs (anti-FOLR1 CoStAR− Td TILs and anti-FOLR1 CoStAR+Td TILs).

Cytokine Production Assessed by MSD Immunoassay

To measure cytokine secretion, non-Td and anti-FOLR1 CoStAR Td TILs were cocultured at a 1:1 ratio (E:T, $1\times105$ TILs:$1\times10^5$ target cells) with autologous tumor digests and at a 8:1 ratio (E:T, $1\times10^5$ TILs:$1.25\times10^4$ target cells) with K-562 or BA/F3 derived engineered cell lines. Cocultures were performed in 200 μL complete TCM in triplicate. In experiments where MHC blocking was conducted, autologous tumor digests were pre-incubated (4° C.) with antibodies directed against MHC Class I (HLA-ABC; 40 μg/mL), MHC Class II (HLA-DRDPDQ; 40 μg/mL), MHC Class I+II (both 40 μg/mL), or an isotype control (Mouse IgG2a; 80 μg/mL) for 45 minutes in 100 μL complete TCM. Following the incubation, TILs were added to the appropriate wells. For all experiments, unstimulated TILs or target cells alone were used as negative controls, and TILs activated with 50 ng/mL phorbol-myristate-acetate (PMA) and 1 μg/mL ionomycin were used as a positive control. The cells were then placed in a 5% CO2 incubator set to 37° C. for 24 hours.

Following the 24-hour incubation, samples were centrifuged at 400×g for 5 minutes, and the supernatant was harvested before storage at −80° C. Upon thaw, samples were appropriately diluted in complete TCM and Diluent 2 from the V-Plex Plus Proinflammatory Panel 1 kit from Meso scale discovery (MSD). The assay was performed per manufacturer's instructions.

Target Cell Cytotoxicity Assessed by Flow Cytometry

To measure the cytotoxic activity of TILs, Non-Td and anti-FOLR1 CoStAR Td TILs were cocultured at a 1:1 ratio (E:T, $1\times10^5$ TILs:$1\times10^5$ target cells) with BA/F3 derived engineered cell lines. Cocultures were performed in 96 well round bottom plates with 200 μL complete TCM in triplicate, and incubated for 20 hours in a 5% CO2 incubator set to 37° C. TILs and target cells were cultured alone as negative controls.

Following the 20-hour coculture, samples were centrifuged at 400×g for 5 minutes, the supernatant was discarded, and samples were analyzed by flow cytometry. Briefly, cells were labelled using 100 μl of fixable viability dye (1:1000 diluted in PBS) and incubated for 10 minutes at room temperature. All washes were performed using BD stain buffer. After the incubation cells were washed, centrifuged at 500×g for 4 minutes, and cell pellets were resuspended in 100 μl of BD stain buffer with FcR Blocking reagent for 10 minutes at room temperature. Following the incubation step, cells were washed once resuspended in 100 μl of BD stain buffer with CD2 and incubated at 4° C. for 25 minutes. Cells were washed twice, and cell pellets were resuspended in 100 μl of BD stain buffer for acquisition on NovoCyte 3005 Flow Cytometer System.

Target cell counts were enumerated by flow cytometry after doublet and dead cell exclusion. CD2-cells were gated from the live gate (SSC-A vs CD2-A) and quantified by the absolute count function of the NovoCyte 3005 Flow Cytometer System.

Target Cell Cytotoxicity Assessed by xCELLigence

Assessment of target cell cytotoxicity by xCELLigence was performed according to manufacturer's instructions. Briefly, E-plates were equilibrated by adding 50 μL TCM per well, incubated at room temperature for 30 minutes, and background electrical impedance was acquired on the RTCA Analyzer (37° C., 5% $CO_2$). Following this, $3\times10^4$ OVCAR-3 derived engineered cell lines in 50 μL TCM were added per well of each E-plate and incubated at room temperature for 30 minutes before cell growth was assessed by electrical impedance (cell index) upon the RTCA Analyzer (37° C., 5% $CO_2$). The cell index was measured every 15 minutes throughout the duration of the assay. Upon reaching confluency (between 24-31 hours), $6\times10^3$ or $1\times10^3$ Non-Td or Td TILs in 100 μL TCM were added to OVCAR-3 derived engineered cell lines (E:T ratios of 1:5 and 1:30, respectively). These were incubated at room temperature for 30 minutes prior to 169 hours of further cell index readings upon the RTCA Analyzer (37° C., 5% $CO_2$). Control conditions included wells containing target cell lines alone, target cell lines with 0.5% Triton X-100 added at OC TIL loading time-point (full lysis control), and TILs alone. The normalized cell index (NCI) was determined according to manufacturer's instructions using RTCA software pro. The area under the NCI curve as extracted from RTCA software pro for the 169-hour period of OC TIL coculture with OVCAR-3 derived engineered cell lines is reported as a quantitative readout. Both the RTCA SP and DP were used. For the 1:30 ratio of Non-Td and Td TILs from 9831 and 9260 tumor digests, cocultures were run in duplicate.

Analysis

Following the production and characterization of TIL from cryopreserved tumor samples, retained input tumor digest samples were thawed and assessed for their expression of FOLR1; the ligand of anti-FOLR1 CoStAR. FOLR1 could be detected on the surface of CD2- cells in all 5 tumors with the proportion of FOLR1 positive cells ranging from 5.44-22.1% (FIG. 45).

Figure 46A:
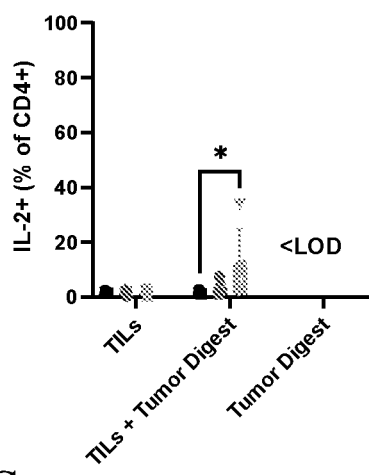

Intracellular flow cytometry was used to assess the frequency of T cells that recognize and respond to autologous tumor. PMA/I stimulation was used as a positive control for frequencies of TIL capable of readily producing IL-2 and TNFα. No IL-2+ or TNFα+ TILs were detected in tumor digests cultured overnight (16 hours) alone with brefeldin A. In contrast, IL-2+ and TNFα+ TILs were detected upon 16-hour coculture of expanded TIL with autologous tumor digest (FIG. 46). CD4+ anti-FOLR1 CoStAR+Td TILs were characterized by significantly higher frequency of IL-2 producing cells compared to Non-Td TILs with a marked 6.56-fold increase (12.0±12.9% vs 1.83±0.55%) (FIG. 46A). Although not significant, CD4+ anti-FOLR1 CoStAR+Td TILs also had a 3.33-fold increase in IL-2 producing cell frequencies compared to anti-FOLR1 CoStAR− Td TILs (12.0±12.9% vs 3.61±3.10%). A slight but significant increase in the number of anti-FOLR1 CoStAR+CD4 T cells producing TNFα (6.96±3.56%) when cultured alone relative to anti-FOLR1 CoStAR− Td TILs (2.58±1.60%), but not Non-Td TILs (3.31±3.62%) was also detected (FIG. 46C).

Upon coculture with the autologous digest, TNFα+ cells seemed to increase in frequency in the anti-FOLR1 CoStAR+Td TIL population, although a statistically significant difference compared to anti-FOLR1 CoStAR− Td and Non-Td TILs was not observed (32.3% vs 17.8% vs 11.6%).

Figure 46B:
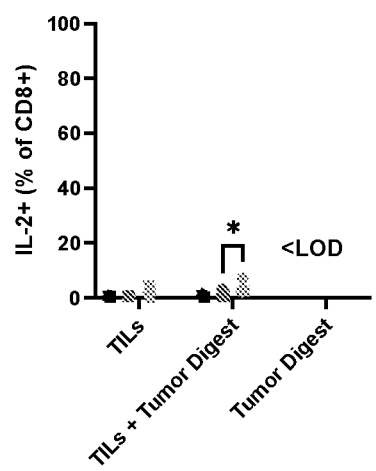
Figure 46C:
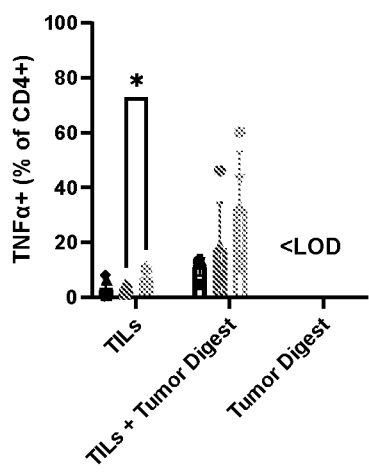
Figure 46D:
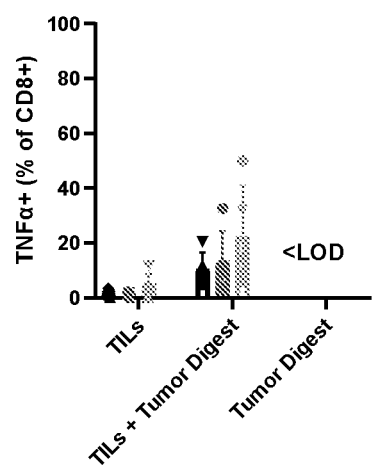

Similar observations were made for the CD8+ population upon coculture with autologous digest (FIG. 46A-D). A significantly higher frequency of CD8+IL-2+ cells was detected by anti-FOLR1 CoStAR+Td TILs (4.13±2.26%) relative to anti-FOLR1 CoStAR− Td TILs (1.42±1.00%; 2.9-fold increase) but not the Non-Td TILs (1.11±0.55%; 4.13-fold increase, p=0.1097) (FIG. 46B). CD8+ TNFα producing cell frequencies were increased in the anti-FOLR1 CoStAR+Td TILs relative to anti-FOLR1 CoStAR-Td and Non-Td TILs, however, these differences did not reach statistical significance (22.6% vs 12.5% vs 10.5%) (FIG. 46D).

Overall, CoStAR modification significantly increased the frequencies of CD4+ and CD8+ cells producing IL-2 upon stimulation with the autologous digest. In the same setting, CD4+ and CD8+ cells frequencies producing TNFα+ trend similarly, although statistical significance was not reached.

Figure 47A:
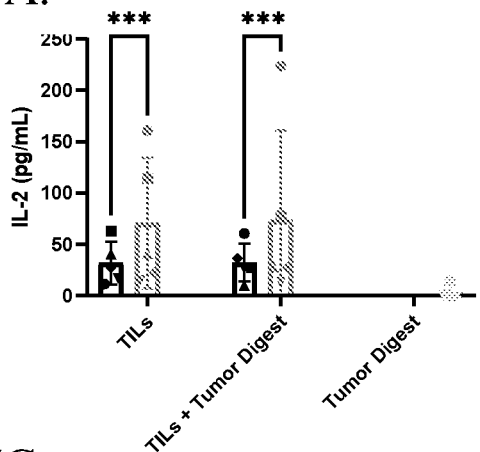
Figure 47B:
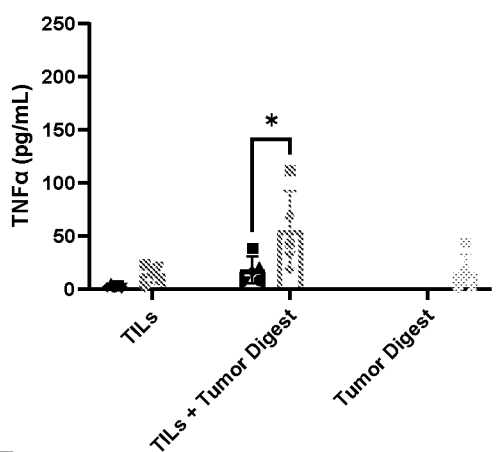
Figure 47C:
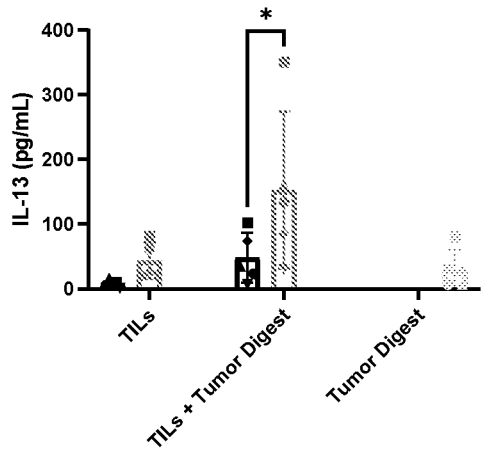
Figure 47D:
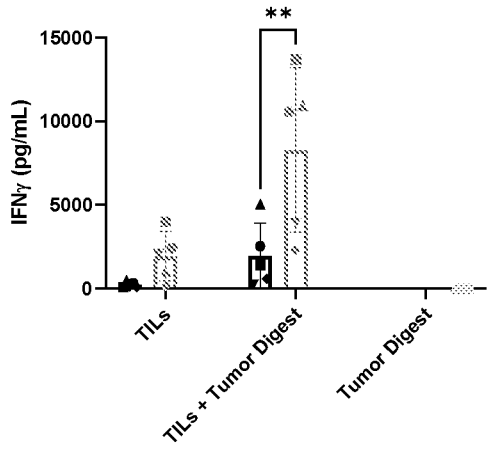

An MSD immunoassay was conducted to assess the quantity of cytokines released upon TIL coculture with autologous digest (FIG. 47A-D). PMA/I stimulation was used as a positive control for cytokine production, which was similar between CoStAR modified and Non-Td TIL. CoStAR modification of TIL led to a statistically significant increase in the secretion of IL-2, TNFα, IL-13 and IFNγ secretion in response to autologous tumor in comparison to Non-Td TILs (FIG. 47A-D). A trend of increased background cytokines levels from Td vs Non-Td TILs when cultured alone (FIG. 47A-D) was observed and was only significant for IL-2 (70.6 μg/mL vs 31.8 μg/mL) (FIG. 47A). Upon coculture with the autologous digest, although IL-2 secretion was significantly higher in Td TILs compared to Non-Td TILs (74.1 μg/mL vs 32.1 μg/mL), this was not different from background levels of TILs cultured alone. Td TILs secreted higher levels of IFNγ in response to autologous digest compared to Non-Td TIL with production levels of 8287 μg/mL vs 1970 μg/mL (FIG. 11D). Similarly, higher levels of of TNFα (55.0 μg/mL vs 18.2 μg/mL, FIG. 47B) and IL-13 (152 μg/mL vs 48.4 μg/mL, FIG. 47C) were detected when Td TILs were cocultured with the autologous digest relative to Non-Td TILs. These indicate a 3-, 4.2- and 3.1-fold increase in TNFα, IFNγ and IL-13 production by CoStAR modified Td TILs, respectively.

Figure 47E:
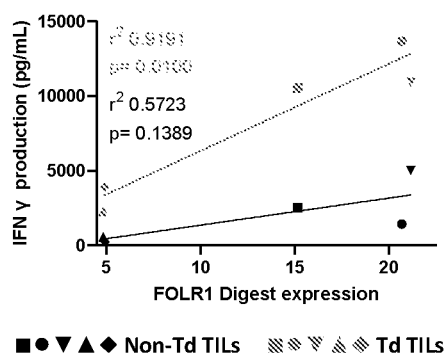

A statistically significant positive correlation ($r^2$=0.9191) was observed between IFNγ released by CoStAR modified TIL upon coculture with autologous tumor and the proportion of tumor digest expressing FOLR1 (FIG. 47E). This correlation was not observed for Non-Td TILs, confirming CoStAR-FOLR1 interactions are key for TIL enhancement. Moreover, CoStAR modified TIL IFNγ release is enhanced even against ovarian tumors harboring frequencies of FOLR1 positive cells as low as 5.44% (FIG. 11E).

MHC blocking antibodies prevent TCRs from engaging their target and mediating TCR signaling. To assess the MHC-restricted antigen recognition of CoStAR modified TIL, Non-Td and Td TILs were cocultured with autologous tumor digest in the presence of MHC blocking, or irrelevant isotype control antibodies, and TIL anti-tumor activity was measured by IFNγ release (FIG. 48). As CoStAR modification enhanced the cytokine production in response to autologous tumor (FIG. 47), percentage reduction relative to TILs cocultured with autologous digest without blocking agents was assessed. The percentage of cytokine release was not significantly different between Non-Td and Td TILs in any of the conditions assessed. Antibodies blocking MHCI, MHCII, and both MHCI and MHCII in combination significantly decreased IFNγ release of both Non-Td (32.7%, 43.1%, and 43.1%, respectively) and Td TILs (35.0%, 27.0%, and 27.3%, respectively), relative to TIL coculture with autologous digest with no antibody present. Additionally, inhibition of cytokine release by the blocking reagents resulted in reduction that was not significantly different between any of the blocking conditions and TILs alone. Isotype control antibody had little effect on IFNγ release from Td (79.1%) or Non-Td TILs (92.7%), relative to TIL coculture with autologous digest with no antibody present. Reductions in IFNγ release from TIL by MHC blocking antibodies were statistically significant in comparison to isotype control and levels of inhibition were not statistically significantly different between Td and Non-Td TILs demonstrating equivalent dependence upon MHC-restricted antigen recognition.

Assessment of robust TIL effector function and the full potential of CoStAR to enhance these functions was demonstrated using a range of engineered cell lines (Table 3). K-562 and BA/F3 cell lines were engineered to express surface bound OKT3 (to induce a CD3 mediated signal 1) or FOLR1 (CoStAR mediated signal 2) or both OKT3 and FOLR1 (for signal 1 and 2). Additionally, the ovarian carcinoma cell line OVCAR-3, which endogenously expresses FOLR1 (63.68% FOLR1+), was engineered to express surface bound OKT3. Using these cell lines, Non-Td and Td TIL were cocultured to assess the impact of CoStAR-mediated effector functions by evaluating cytokine production and secretion by intracellular flow cytometry and MSD immunoassay, respectively.

TABLE 18

Engineered cell lines

| Parental line | Manufacturer | Derived/Engineered line |
|---|---|---|
| K-562 | ATCC | K-562 (no signal) |
| | | K-562-OKT3 (signal 1) |
| | | K-562-FOLR1 (signal 2) |
| | | K-562-OKT3-FOLR1 (signal 1 & 2) |
| OVCAR-3 | ATCC | OVCAR-3 (signal 2) |
| | | OVCAR3-OKT3 (signal 1 & 2) |
| BA/F3 | DSMZ | BA/F3 (no signal) |
| | | BA/F3-OKT3 (signal 1) |
| | | BA/F3-FOLRI (signal 2) |
| | | BA/F3-OKT3-FOLRI (signal 1 & 2) |

Intracellular flow cytometry was used to enumerate cytokine producing cells after 16-hour coculture with engineered K-562 and OVCAR-3 cell lines (FIG. 49). IL-2 producing cell frequencies in response to K-562 and K-562-FOLR1 were minimal for CD4+(1.47-4.17%) and CD8+(0.23-3.73%) cells across all populations of interest (FIG. 49A). Culture with K-562-OKT3 resulted in IL-2+ cell frequencies of 23.0-34.0% and 20.0-39.7% for CD4+ and CD8+ cell populations, respectively. No statistically significant difference in IL-2 producing cell frequencies was observed between Non-Td and anti-FOLR1 CoStAR+/− populations upon coculture with control cell lines, with the exception of CD8+ anti-FOLR1 CoStAR+Td TILs which were higher than anti-FOLR1 CoStAR− Td TILs, but not Non-Td TILs (39.7±21.7% vs 20.0±15.1% vs 24.8±13.4%, respectively). Coculture with the K-562-OKT3-FOLR1 cell line resulted in significantly higher frequencies of CD4+IL-2 producing anti-FOLR1 CoStAR+Td TILs with a marked increase of 1.84- and 2.38-fold relative to anti-FOLR1 CoStAR− Td and Non-Td TILs, respectively (54.9±20.5% vs 29.9±19.4% vs 23.1±13.4%, respectively). The same observation was true for the CD8+IL-2+ cell frequencies with a 2.53- and 2.29-fold increase in anti-FOLR1 CoStAR+Td TILs compared to anti-FOLR1 CoStAR− Td and Non-Td TILs, respectively (53.0±23.9 vs 21.0±15.5% vs 23.2±12.2%, respectively).

TILs cultured alone or cocultured with OVCAR-3 were characterized by minimal frequencies of IL-2 producing cells for both CD4+(0.78-1.38%) and CD8+(0.22-0.80%) populations (FIG. 49A). Upon stimulation with both signals provided by the OVCAR-3-OKT3 cell line, a significant increase in the frequency of IL-2 producing cells was observed by the anti-FOLR1 CoStAR+Td TILs (39.1±14.5%) in the CD4+ population with a 1.74- and a 2.46-fold increase in comparison to anti-FOLR1 CoStAR− Td TILs (22.4±14.0%) and Non-Td TILs (15.9±9.47%), respectively. Similarly, in the CD8+ population, anti-FOLR1 CoStAR+Td TILs (34.1±13.2%) demonstrated a 2.65- and 2.36-fold increase in IL-2 producing cell frequencies compared to anti-FOLR1 CoStAR− Td TILs (12.9±10.2%) and Non-Td TILs (14.5±9.58%), respectively.

CD4+ TNFα positive cell frequencies were significantly higher in the anti-FOLR1 CoStAR+Td TILs cocultured with K-562-OKT3 compared to anti-FOLR1 CoStAR− Td TILs (75.9±8.35% vs 66.2±5.04%), and with K-562-FOLR1 compared to Non-Td TILs (12.6±7.08% vs 0.73±0.34%) (FIG. 49B). No significance was observed in the same conditions for the CD8+TNFα positive cell populations. Stimulation with K-562-OKT3-FOLR1 expressing both signals resulted in higher frequencies of TNFα producing CD4+ cells relative to both anti-FOLR1 CoStAR− Td with 1.31-fold increase and Non-Td TILs with 1.39-fold increase (89.3±6.15% vs 68.1±4.99% vs 64.2±14.0%, respectively). The same trend was observed in the CD8+ population, however, statistical significance was only reached when comparing anti-FOLR1 CoStAR+Td TILs to anti-FOLR1 CoStAR− Td TILs (1.25-fold increase), but not the Non-Td TILs (1.14-fold increase) (90.2±5.35 vs 72.2±9.92% vs 79.3±6.30%, respectively).

In conditions where TILs were cultured alone, small but significant differences in TNFα percentage were observed between the anti-FOLR1 CoStAR+Td TILs compared to anti-FOLR1 CoStAR− Td TILs in CD4+(5.81±3.38% vs 1.85±1.42%) and CD8+(4.85±2.46% vs 1.53±0.76%) cell populations (FIG. 49B). There were no significant differences compared to Non-Td TILs in either population. In the presence of OVCAR-3 expressing signal 2, a slight but significantly higher CD4+ TNFα+ cell frequencies were detected in the anti-FOLR1 CoStAR+Td TILs relative to both the anti-FOLR1 CoStAR− Td and Non-Td TILs (8.29±4.34% vs 1.00±0.78% vs 0.40±0.23%, respectively). On the contrary, no differences were observed between these populations in the CD8+ cells. Importantly, significantly higher frequencies of CD4+ TNFα producing cells were detected upon coculture of the TILs with the OVCAR-3-OKT3 cell line in anti-FOLR1 CoStAR+Td TILs (83.5±6.99%) with a 1.24- and 1.37-fold increase compared to anti-FOLR1 CoStAR+Td TILs (67.4±5.35%) and Non-Td TILs (60.9±10.9%), respectively. Similar frequencies were detected in the CD8+ cell population, with a 1.31-fold increase between anti-FOLR1 CoStAR+Td and anti-FOLR1 CoStAR− Td TILs (88.5±3.72% vs 67.8±10.3%) and a 1.21-fold increase between anti-FOLR1 CoStAR+Td and Non-Td TILs (88.5±3.72% vs 73.2±4.57%).

Collectively, these results demonstrate a significant increase in the frequencies of IL-2+ and TNFα+ cells in the CoStAR+ fraction of the modified TILs compared to the CoStAR− fraction and Non-Td TILs when coculture with engineered cell lines expressing both signals. Although minimal, some background of higher frequencies of TNFα+ cell populations were observed in both CD4+ and CD8+ cells. Similarly, some enhancement of the CoStAR effect was observed by higher frequencies of CD8+IL-2+ and CD4+ TNFα+ cells in cocultures with K-562-OKT3 cell line, which could be potentially explained by the low levels of FOLR1 expression on the K-562.

Figures 50A, 50B:
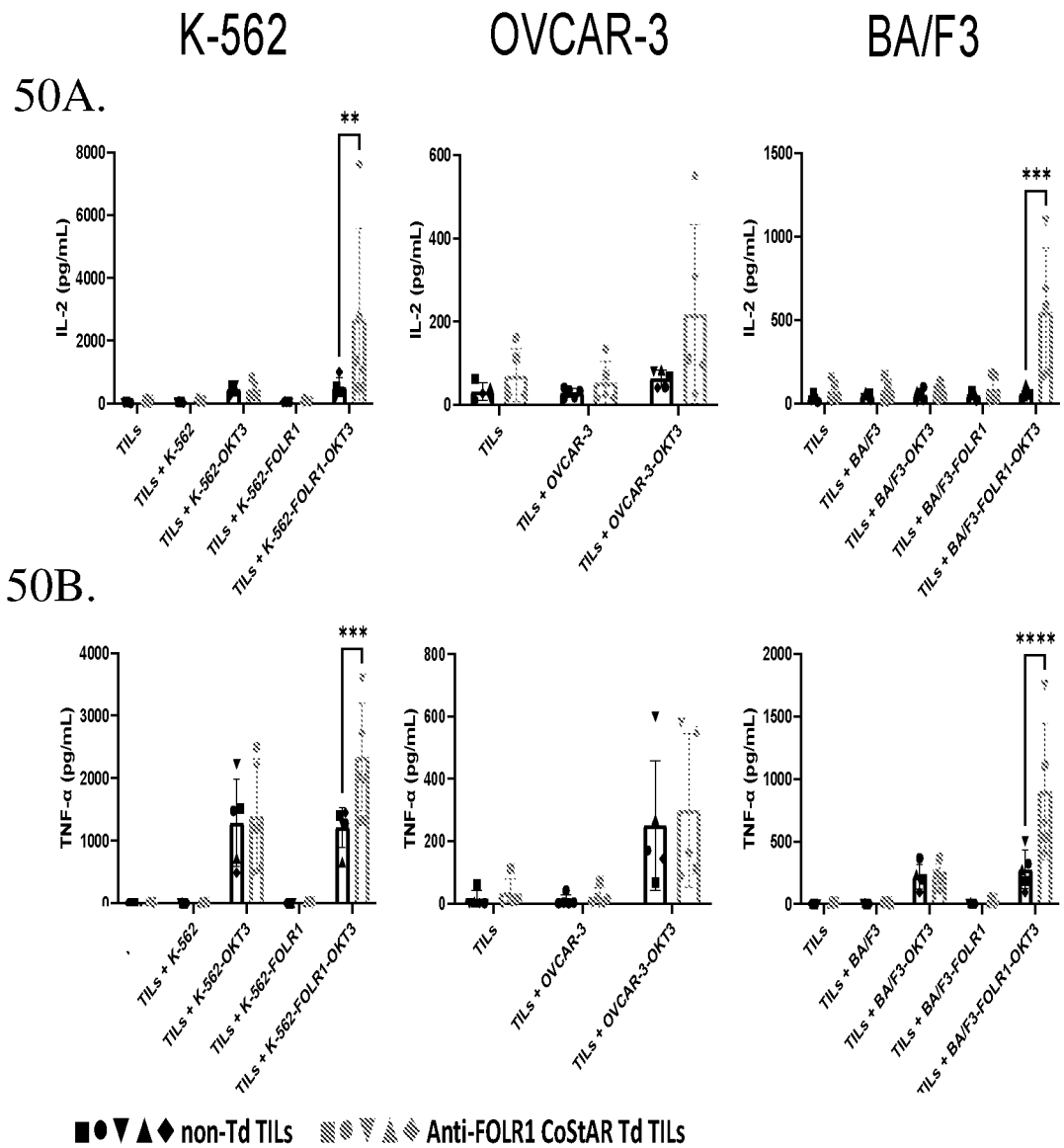

In addition to assessing the frequency of activated T cells by flow cytometry, MSD immunoassay was used to evaluate levels of secreted cytokines upon coculture with K-562 and BA/F3 engineered cell lines (Table 3). Cytokine secretion was minimal in cocultures with wild type cell lines or those engineered to express signal 2 alone (FIG. 50). IL-2 release stimulated by K-562-OKT3-FOLR1 cell lines was higher in the Td TILs (2682 pg/mL) compared to the Non-Td TILs (521.5 pg/mL) demonstrating a 5.14-fold increase (FIG. 50A). Similarly, in TILs cocultured with BA/F3-OKT3-FOLR1, IL-2 secretion was 9.31-fold higher in the Td TILs compared to Non-Td TILs (FIG. 50A). Significantly higher TNFα production was also detected in Td TILs compared to Non-Td TILs when cocultured with K-562-OKT3-FOLR1 (2337 pg/ml vs 1211 pg/mL, 1.93-fold increase) and BA/F3-OKT3-FOLR1 (900.3 pg/mL vs 278.0 pg/mL, 3.24-fold increase).

Figures 50C, 50D:
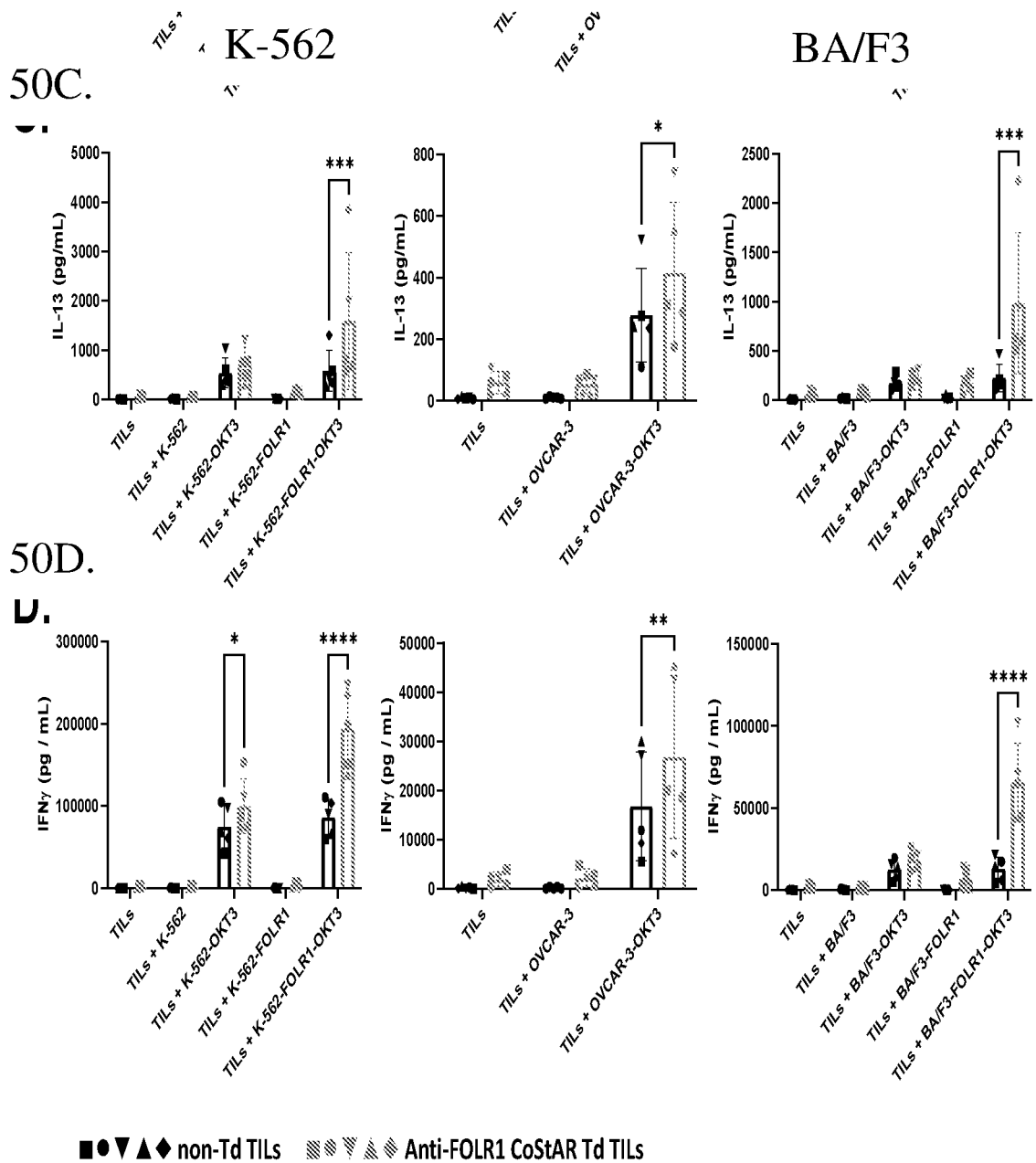

IL-13 and IFNγ production was also significantly higher upon stimulation with cell lines expressing both signals (FIG. 50C-D). More specifically, in response to stimulation with K-562-OKT3-FORL1 Td TILs secreted high levels of IL-13 (1590 pg/mL) compared with Non-Td TILs (587.0 pg/mL), showing a 2.71 fold higher secretion by OKT3-FORL1 Td TILs. Similarly, a 2.26-fold higher amount of IFNγ was observed in OKT3-FORL1 Td TILs (194559 pg/mL) vs Non-Td TILs (86183 pg/mL). Similarly, IL-13 and IFNγ concentrations were significantly elevated in Td TILs cocultured with BA/F3-OKT3-FOLR1 over Non-Td TILs in the same conditions with a 4.35- (983.9 pg/mL vs 226.1 pg/mL) and 5.13-fold (65594 μg/mL vs 12786 μg/mL) greater cytokine secretion, respectively (FIG. 50C-D). Interestingly, a significantly higher IFNγ secretion was observed by Td TILs compared to Non-Td TILs in cocultures with K-562-OKT3 (1.33-fold increase, 98804 μg/mL vs 74917 μg/mL) which could be attributed to the low levels of FOLR1 expression on the K-562 cells.

To determine the impact of CoStAR modification on the cytotoxic capacity of TILs, flow cytometry-based and xCELLigence-based killing assays were conducted against BA/F3 and OVCAR-3 engineered cell lines, respectively (FIG. 51). In cocultures assessed by flow cytometry, OKT3 was sufficient to induce cytotoxicity as Non-Td and Td TILs killed specifically BA/F3 cells expressing either OKT3 or both OKT3 and FOLF1 with no significant differences detected (FIG. 51A). Importantly, no cytotoxicity was observed against BA/F3 or BA/F3-FOLR1 demonstrating the requirement of signal 1 to induce killing. Similar observations were true for cocultures with OVCAR-3 cells as target cell lines using RTCA assays (FIG. 51B). In cocultures with OVCAR-3 OKT3 expressing both signals, there was no significant difference in the AUC (NCI× hours) between Non-Td and Td-TILs at any E:T ratio tested. OVCAR-3 cells alone were not eliminated at early time-points, however a slight decrease in NCI of OVCAR-3 cells in 4 of 5 donors occurred following addition of Non-Td or Td TILs at an E:T 1:5 ratio at later time points.

Collectively, these data demonstrate a lack of cytotoxicity mediated by CoStAR bearing TIL against target cells expressing CoStAR target alone. Engagement of TCR was sufficient in mediating cytotoxicity in both Non-Td and Td TILs in all assays, showing no impact of CoStAR on cytotoxicity in the presence of a potent signal 1 such as OKT3.

Example 17

Materials and Methods

Co-culture was set up at an effector to target ratio of 8:1 (E:T, 1×105 cells:1.25×104 cells) for the cell lines. T cells were resuspended at 1×106 cells/mL in complete TCM and used at 100 μL per well. Cell line targets were resuspended at 1.25×105 cells/mL in complete TCM and used at 100 μL per well. T-cells alone and targets alone were set up as negative controls. T-cells stimulated with PMA (50 ng/mL)/Ionomycin (1 μg/mL) were set up as positive controls. 100 μL per well was added to TILs alone, targets alone and TILs stimulated with PMA/I. Final volume was 200 μL per well. Triplicates were set up where possible. Cells were incubated at 37° C. for 24 hours. 24 hours post incubation plates were spun down at 400×g for 5 minutes. Supernatant was collected and distributed 60 μL aliquots of each into 3×96 well U-bottom plates. Supernatant was frozen at −80° C., 3 plate aliquots each. V-PLEX Proinflammatory Panel 1 Human Kit form MSD was used as per manufacturers instructions. One aliquot of each sample was thawed to be used. Initial dilution was performed in RPMI medium, and final dilution was performed using Diluent 2 as per manufacturers instructions Evaluation of CoStAR expressing cells was conducted on 1e5 live T cells/well. Cells ere centrifuged (400 g, 5 min), followed by removal of supernatant (flicking) and washing cells in 200 uL PBS, centrifugation (400 g, 5 min) and removal of supernatent (flicking). Cells were resuspended in 100 uL diluted LiveDead Viability dye (1:1000 in PBS) and incubated for 15 min @ RT in the dark. 100 uL PEF was added to cells and cells were centrifuged (400 g, 5 min), supernatant was removed (flicking) and cells were washed in 200 uL PEF, centrifuged (400 g, 5 min) and supernatant was removed (flicking). 5) Cells were resuspended in 100 uL diluted FcR block (1:100 in PEF) and incubated for 15 min @ RT in the dark. 100 uL PEF was added to cells and cells were centrifuged (400 g, 5 min), supernatant was removed (flicking) and cells were washed in 200 uL PEF, centrifuged (400 g, 5 min) and supernatant was removed (flicking). Cells were resuspended in 100 uL diluted antibody mastermix and incubated for 25 min at 4° C. in the dark. Cells were centrifuged (400 g, 5 min), supernatant was removed (flicking) and cells were washed in 200 uL PEF, centrifuged (400 g, 5 min) and supernatant was removed (flicking). 100 uL PEF was added to cells and cells were centrifuged (400 g, 5 min), supernatant was removed (flicking) and cells were washed in 200 uL PEF, centrifuged (400 g, 5 min) and supernatant was removed (flicking). 100 uL PEF was added to cells and flow cytometry results were acquired.

Results

To evaluate the relevance of MSLN as a CoStAR target, mSLN expression was evaluated in various cancer cell types including both primary and metastatic tumors. The results from the evaluation are shown in FIG. 61A-B, where the % of mesothelin+ cells approached 100% in multiple samples and all but four cancer types tested (cervical SSC, gastric adenocarcinoma, NSCLC SSC, NSCLC NOS) showed replicates with at least 50% of mesothelin+ cells.

Accordingly, CoStARs bearing anti-MSLN scFvs were developed. Six different CoStARs comprising the same linker, spacer, TM, and intracellular domains but possessing different scFvs directed against MSLN are depicted in FIG. 62. Expression of the CoStARs in T cells was evaluated by measuring markers for MSLN-PE and CD34. FIG. 62 demonstrates high expression of both CD34 and MSLN-PE regardless of which scFv was included in the CoStAR. Flow cytometry plots of CD34 and MSLN-PE expression demonstrate percentages T cells double positive for CD34 and rhMSLN-PE ranging from 12.87-46.59% (See FIG. 63A-B). CoStAR expression in transduced T cells was further examined by evaluating expression of MSLN-PE and CD34 further gated for CD4 and CD8 T cells (See FIG. 64). As can be seen in FIG. 64, CD4 expression levels are comparable to those seen in CD3, whereas CD34 expression is slightly decreased in CD8 cells for all scFvs. Alternatively, transduced cells were placed into a rapid expansion protocol (REP) for 14 days following CD34 sorting (See FIG. 65). Similarly to what was observed in FIG. 64, CD4 expression levels were comparable to those seen in CD3, however, CD34 expression levels were higher in CD8 cells than was previously seen without the REP (See FIG. 65). Data from a separate experiment also involving MSLN CoStARs expanded with a REP is present in in FIG. 66, showing high expression levels of CD34 and MSLN-PE across three biological replicates.

To evaluate function of the MSLN targeting CoStARs, donor PBMCs were transduced with a lentivirus for 1 of the 6 MSLN targeting CoStARs. Transduced cells were allowed outgrowth, followed by CD34 selection and a 12 day REP, followed by co-culture with the naturally MSLN and OKT3 expressing Ovcar3 cell line, where cytokine release by CoStAR expressing cells was evaluated (See FIG. 67). MSLN expression was evaluated in Ovcar3 and Ovcar3-OKT-3 cells via flow cytometry (See FIG. 68). FIG. 66 demonstrates that both Ovcar3 and Ovcar3-OKT-3 cells have similar levels of MSLN expression at 37.49 and 36.6% of cells positive for MSLN respectively.

Cytokine expression in healthy donor T cells transduced with scFV anti-MSLN CoStARs expressing varied scFv domains and either a CD8 spacer or truncated CD28 spacer and cocultured with K562 cell lines was assessed when CoStAR expressing cells were cocultured with Ovcar and Ovcar-OKT3 cells (FIG. 69). FIG. 69 shows that optimal expression of IL-2, IFNγ, and TNFα required both signal 1 and signal 2 as evidenced by the robust responses in Ovcar3-OKT-3 cells and weak responses in Ovcar3 cells. Furthermore, CoStARs with both CD8 spacers or truncated CD28 spacers were both capable of robust cytokine responses (See FIG. 69).

A similar experiment was performed in FIG. 70 where healthy donor T cells were transduced with CoStARs with varied scFvs and CD28, truncated CD28, or CD28 spacer domains. The CoStAR expressing cells were co-incubated with K562-MSLN or K562-MSLN-OKT-3 cells and cytokine release was evaluated. FIG. 70 shows that optimal expression of IL-2, IFNγ, and TNFα by the CoStAR expressing cells required both signal 1 and signal 2 as evidenced by the robust responses in K562-MSLN-OKT-3 cells and weak responses in K562-MSLN cells. Additionally, CoStAR expressing cells with CD28 spacers exhibited slightly higher secretion of IL-2 and IFNγ in comparison to the truncated CD28 and CD8 domains (FIG. 70).

Example 18

Materials and Methods

Tumor digests were thawed in TCM base media supplemented with 10% FBS, 1× Gentamycin/Amphotericin (500× stock), 50 µg/mL vancomycin and 3000 IU/mL IL2. The cells were resuspended at a concentration of 0.5 or $1 \times 10^6$ cells/mL for seeding. For each sample, cells were seeded at either 0.5M/mL in a 24 well plate or 1M/2 mL in 6 well plate. Cells were seeded such that one well was kept for non-Td TIL and another well for anti-CEA CoStAR-Td TIL generation. Cells were placed in a humidified incubator 37° C. with 5% $CO_2$. On day 3 and 4, the appropriate volume of lentivirus was diluted in 0.1 mL media for 24 well plate or 0.5 mL media for 6 well plate and added to the wells to be transduced. On day 8, cells were fed with TCM base media supplemented with 10% FBS, 1× Gentamycin/Amphotericin (500× stock), 50 µg/mL vancomycin and 6000 IU/mL IL2. On day 10, cells were collected from all conditions and counted using Vicell. Based on cell counts, TILs were stimulated in a 6 well GRex with OKT3 (30 ng/mL), IL2 (3000 U/mL) and irradiated feeders at a 1:200 ratio in TCM base media with 8% human AB serum. On day 15, the cells were transferred to a GRex 6M and TCM base media with 8% human AB serum and IL2 at 3000 U/mL was added. On day 18, TILs were counted and either media was changed for cell counts <1e6 cells/mL or conditions were split of cell counts >1e6 cells/mL. All conditions were harvested and frozen on day 21.

Results

The present example tests for fold expansion of T cells from four different tumor types following transduction with either CTP386.1 or CTP387.1 CEA targeting CoStAR constructs. FIG. 71 shows variable levels of expansion across T cells from different tumor types, with cells from CRC generally having less expansion than cells from NSCLC, OV, and MEL tumors.

In addition to expansion, transduction efficiency of the two constructs was also evaluated and the results are shown in FIG. 72. As shown in FIG. 72, transduction efficiency ranged from approximately 20-55% with CRC11974 having the highest transduction efficiency for both constructs and CRC11959 having the lowest.

Transduction efficiency was also broken down across T cell subtypes. CD4 and CD8 T cells were evaluated for CoStAR transduction efficiency and the results are shown in FIG. 73. As can be seen in FIG. 73, transduction efficiency was higher in CD4 cells for CRC and ovarian tumor derived T cells, while transduction efficiency was higher in CD8 T cells for NCSLC and melanoma derived T cells.

In addition, T cell memory phenotype was evaluated across T cells transduced with the 2 CoStAR constructs. Expression levels of CCR7 and CD45RA were evaluated on day 21 to determine T cell memory phenotype and the results are shown in FIG. 74.

Example 19

Materials and Methods

Effector (ie, Non-Td and Td) T cells were rested at $1 \times 10^6$ cells/mL in TCM (T cell media) and incubated overnight at 37° C. with 5% $CO_2$. On the day of coculture, the effector T cells were collected and resuspended at $1 \times 10^6$ cells/mL. Target cell lines (ie, K562 WT, K562 OKT3, K562 CEACAM5 and K562 OKT3 CEACAM5) were collected and resuspended at $1 \times 10^5$ cells/mL. 50 uL T cells and targets were plated in a 96 well U bottom plate to achieve a 10:1 E:T ratio. The volume of media in all wells were made up to 200 uL. Following overnight coculture, plates were collected and centrifuged at 400×g for 5 minutes. 100 mL of supernatant was collected from each well and stored at −80° C. prior to analysis of cytokine content using an MSD V-Plex Plus Proinflammatory Panel 1 kit. The assay was carried out according to the manufacturer's instructions and analysis performed using MSD discovery workbench software.
Results Sorted transduced TILs underwent functional testing for cytokine release following co-culture with K562 target cells expressing signal 1, signal 2, or both signal 1 and signal 2. The experiment was carried out and levels of IL-2, TNFφ, and IFNγ were measured the results are shown in FIGS. 75-78. FIG. 75 shows the results for CRC cells, FIG. 76 shows NSCLC, FIG. 77 shows OV-9962, and FIG. 78 shows melanoma derived T cells. In all TIL sources, target cells expressing both signal 1 and signal 2 results in higher cytokine levels than target cells with signal 1 or 2 alone. Additionally, IFNγ was induced at higher levels than IL-2 or TNFα (See FIGS. 75-78).

Example 20

Materials and Methods

Effector (ie, Non-Td and Td) T cells were rested at 1×10$^6$ cells/mL in TCM (T cell media) and incubated overnight at 37° C. with 5% $CO_2$. On the day of coculture, the effector T cells were collected and resuspended at 1×10$^6$ cells/mL. Irradiated target cell line (ie, K562 OKT3 CEACAM5) was collected and resuspended at 0.2×10$^6$ cells/mL. 50 uL T cells and targets were plated in a 96 well U bottom plate to achieve a 5:1 E:T ratio. The volume of media in all wells were made up to 200 uL. Plates were incubated 37° C. with 5% $CO_2$ and re-stimulated with targets weekly.

To re-stimulate with targets every week (ie, day 7, 14, 21, 28 and 35), 20 uL cell suspension was collected from each well to obtain cell counts using a Vicell and assess fold expansion. 50 uL cell suspension was collected to stain and evaluate CoStAR expression levels. Remaining cell suspension was centrifuged at 400×g for 5 mins and supernatant discarded. The cell pellets were resuspended in 50 uL media. Irradiated K562 OKT3 CEACAM5 cell line was resuspended at 1×10$^6$ cells/mL. Targets were then added at 5:1 ratio to each well based on effector cell counts obtained. The volume of media in all wells were made up to 200 uL and incubated for a week at 37° C. with 5% $CO_2$ until the next round of re-stimulation.
Results Fold expansion and transduction efficiency were evaluated in CoStAR transduced cells following weekly stimulation with K562 OKT3 CECAMS target cells. The evaluation was conducted and the results are shown in FIGS. 79-82. FIG. 75 shows the results for CRC 11959 and CRC 11974 cells, FIG. 76 shows NSCLC 9332 and NSCLC 9596, FIG. 77 shows OV-9962, and FIG. 78 shows MEL CC50, MEL 11909, and MEL 17614 derived T cells. As can be seen in FIG. 79-82, CoStAR expressing cells show enhanced proliferation compared to nontransduced cell co-incubated with the target cells, particularly the cells transduced with CTP387.1 construct. Transduction efficiency on day 21 or 28 ranged from approximately 20-80%, with the lowest transduction efficiency in OV9662 cells and the high levels for both constructs seen in MEL CC50 and MEL 17614.

Example 21

Materials and Methods

The following examples provide the details regarding Example 17 above, the results of which are presented in FIGS. 70A and 70B. Cytokine expression analysis was performed for HD T cells transduced with CEACAM or MSLN ScFv co-cultured with CEACAM and MSLN K562 cell lines. The first objective of this work was to assess if there is an enhancement of cytokine expression (T-cell function) when co-culturing T-cells transduced with anti-CEA scFv candidates with either CEACAM5 (signal 2 only) or CEACAM5/OKT3 (signal 1+2) expressing K562.luc.puro cell lines. IL-2, IFN-y or TNF-a levels were measured using MSD for each of the scFv constructs (MFE23, MFE23 (Q>K), hMFE23, CEA6, BW431/26 and hT84,66) transduced T-cells. K562.luc.CEACAM5 and K562.luc.puro.OKT3.GFP.CEACAM5 were utilized as they should provide a cleaner system then using the Lovo cell line (CEACAM5+). The second objective was to assess if there is an enhancement of cytokine expression (T-cell function) when co-culturing T-cells transduced with anti-MSLN scFv candidates with either MSLN (signal 2 only) or MSLN/OKT3 (signal 1+2) expressing K562.luc.puro cell lines. IL-2, IFN-y or TNF-a levels were measured using MSD for each of the scFv constructs (MFE23, MFE23 (Q>K), hMFE23, CEA6, BW431/26 and hT84,66) transduced T-cells. K562.luc.CEACAM5 and K562.luc.puro.OKT3.GFP.CEACAM5 were utilized as they should provide a cleaner system then using the Ovcar3 cell line (CEACAM5+). This work includes the Production of HD with CoStAR2 production of HD with CoStAR2 CEA ScFv and MSLN ScFv constructs to assess expression and functionality. The co-culture was set up at an effector to target ratio of 8:1 (E:T, 1×105 cells:1.25×104 cells) for the cell lines. All co-cultures were incubated for 24 hours before collection and freezing of the supernatant.

The following is the entire process of this experiment in regards to the order of the work that was completed: 1. PBMC isolation from buffy coats by density gradient separation using Ficoll-Paque centrifugation. 2. T-cell isolation using the Human T-cell isolation kit (STEMCELL). 3. Transduction of T-cells. 4. Transduction assessment by flow cytometry stain. 5. Day 5 count of cells. 6. CD34 selection of cells using MicroBeads (Milteni Biotec). 7. Transduction assessment by flow cytometry pre-REP. 8. Rapid Expansion Protocol of T-cells (REP). 9. Transduction assessment by flow cytometry post-REP. 10. Post-REP cell counts. 11. Co-culture set up with antigen or OKT3 presenting engineered lines (K562.luc.puro.CEACAM5, K562.luc.puro.OKT3.GFP.CEACAM5, K562.luc.puro. MSLN or K562.luc.puro.OKT3.GFP.MSLN). 12. Analysis of supernatant from co-culture using the Meso Scale Discovery (MSD) platform (to measure IFN-y, IL-2 & TNF-a secretion).
Media Preparation PEF media was prepared by adding 2 mL of EDTA to 500 mL phosphate buffered saline (PBS) bottle, followed by adding 2.5 mL fetal bovine serum. Complete TCM was prepared by adding 50 mL fetal bovine serum to 450 mL bottle of RPMI 1640, followed by adding 5 mL penicillin-streptomycin, 5 mL HEPES solution, and 500 μL 2-Mercaptoethanol (50 mM).
Preparation of the Cells Before T Cell Isolation NBC PBMC were obtained from processed buffy coats in 210831 4× HD PBMC isolation and banking. 5× vials of each donor PBMCs (NBC571, NBC572, NBC573) were thawed in a 37° C. water bath. To minimise the time the cells spend thawed in the freezing media, vials were thawed and washed in batches of 5 vials. The contents of the vials were transferred into one 50 mL falcon tube per donor and top up with TCM. The cells were centrifuged at 400×g for 5 minutes and washed once with 50 mL TCM each. The cells were counted using the Vicell-Blu (10 μL of sample+190 μL DPBS, Dilution 1:20)

T-Cell Isolation

The PBMCs were washed in PEF and then resuspended at 5×107 cells/mL. 2 mL of the resuspended cells were transferred per 5 mL facs tubes. T cells were isolated using EasySep™ Human T Cell Isolation Kit according to the manufacturer's protocol. After the isolation, cells were collected, transferred the into 2×50 mL falcon tubes and washed once with complete TCM. Cells were resuspended in 20 mL of complete TCM per 50 mL falcon. 10 μL, of each were taken and resuspend in 190 μL of PBS (Dilution 1:20). The cells were counted using the ViCELL-Blu.

T-Cell Activation by DynaBeads

The cells were collected from the isolations and transferred onto 50 mL falcon tubes. The isolated T cells were centrifuged at 400×g for 5 minutes. The T cells were washed in complete TCM and then resuspended at 1×106 cells/mL based on the total counts. The T cells were transferred into T75 flasks. 200 IU/mL IL-2 (1:5000 dilution of the 106 IU/mL stock) were added. The CTS Dynabeads™ CD3/CD28 magnetic beads were resuspended in the vial (i.e., vortex for 30 sec). 0.83 μL CTS Dynabeads™ CD3/CD28 were added per ml of T-cell suspension (1:3 bead:cell ratio). The culture was gently rocked to resuspend the Dynabeads and incubated for 48 hours.

Preparation of T Cells for Lentiviral Transduction

The activated T cells were transferred from the flasks into a 50 mL falcon tube. And centrifuged at 400×g for 5 minutes. The cells were resuspended in 20 mL of complete T cells each. 10 μL of each were taken and and resuspended in 190 μL of PBS (Dilution 1:20). The cells were counted using the ViCELL-Blu. The cells were centrifuged at 400×g for 5 minutes and resuspend at 1×106 cells/mL. The appropriate number of cells and virus needed was estimated—for $10^5$ transduced cells you will need 100 μL of lentivirus of chosen titre.

Lentiviral aliquots were thawed at 37° C. water bath. The amount of time the virus is at room temperature was minimized by placing in the 4° C. fridge. The number of T cells needed per condition was transferred into a sterile Eppendorf tube (i.e., 5×105 T cells) and spun it down (400×g, 5 minutes, RT). Supernatant was discarded, excess media was removed with pipette and resuspended in lentivirus at a MOI of 5 for all eg. 100 μL per 105 T-cells (i.e., 5×105 T cells in 500 μL of lentivirus). 0.4 mg/mL polybrene was prepared by diluting the stock (100 mg/mL) 25× with complete TCM (to get 4 mg/mL).0.1 μL of 0.4 mg/mL polybrene was added per 100 μL (i.e., 0.5 μl into 500 μL of virus). 104 IU/mL IL-2 was prepared by diluting the stock (106 IU/mL) 100× with complete TCM. 2 μL of 104 IU/mL IL-2 was added per 100 μL (i.e. 10 uL into 500 uL of virus). 500 μL of cells was properly resuspended and plated with virus per well onto a flat-bottom 48-well plate. The plate was spun at 1200×g for 1.5 hour at 32° C. 8. The cells rested after spin for 5 hours. At the end of incubation top up to 700/well with complete TCM with 200 IU/mL IL-2. 10. Incubation proceeded for 72 hours.

Removal of Dynabeads from Culture

The cells were pipetted up and down thoroughly (to detach Dynabeads) and transferred into an Eppendorf tube/FACS tube. Ensure this is done effectively for maximum recovery of cells. The tube was pressed against the small magnet (Eppendorf tube)/place it into the big magnet (FACS tube) for ~3 min. The cells were carefully transferred (Eppendorf)/pour them out (FACS), onto a new falcon tubes and centrifuged at 400×g for 5 minutes. The supernatant was discarded and resuspend the cells in 1.2 mL each. The cells were counted using the ViCELL-Blu 1. 10 μL of each were taken and resuspended in 1904 of PBS (Dilution 1:20).

The cells were resuspended at a concentration of $1 \times 10^6$ cells/mL. 200 IU/mL IL-2 were added (1:5000 dilution of the $10^6$ IU/mL stock). 2. Before adding IL-2, $1 \times 10^5$ of each condition were taken for transduction assessment. Cell should be kept in complete TCM with 200 IU/mL IL-2 and will grow stably for at least 2 weeks (donor variability). The next day and onwards, cells can be stained for transduction efficiency, sorted and expanded, or used for functional assays.

Preparation of Cells for Stain

The NBC571, NBC572 and NBC573 T cells (MOCK and transduced) were stained. $1 \times 10^5$ cells per well were used for the staining. $1 \times 10^5$ cells per well were placed in a 96-well round-bottom plate. The well contents were clearly labelled with an appropriate identifier using an alcohol resistant marker pen. IL-2 (200 IU/mL) was added to the rest of the cells and the cells were placed in a 37° C. incubator 5% CO2.

Staining Protocol

The wells were topped up to 200 μL using PBS and the plate was spun at 500×g for 3 minutes. The supernatant was discarded by flicking off the plate. Fixable Viability Dye efluorTM450 was prepared by diluting stock 1:1000 in PBS. 100 μL of Viability Dye preparation is required per sample. 100 μL of viability stain per sample was added and samples were incubated at RT for 10 minutes in the dark. After the incubation period, the wells were topped up with 100 μL of BD stain buffer and the plate was spun at 500×g for 3 minutes. The supernatant was discarded by flicking off. A working solution of Fc blocking reagent was prepared by diluting stock 1 in 100 in BD stain buffer. 100 μL of Fc blocking solution is required per sample. 10. 100 μL of the Fc blocking solution was added per sample and incubated at RT for 10 minutes in the dark. After the incubation period, the wells were topped up with 100 μL of stain buffer and the plate was spun at 500×g for 3 minutes. The supernatant was discarded by flicking off. 13. The CEA-Fc protein was prepared by diluting in BD stain buffer. 100 μL of the CEACAM5 protein FC/BD was mixed to the appropriate wells. For wells not receiving CEACAM5 protein-FC mix 100 μl of BD stain buffer alone was added. The plate was incubated at 4° C. for 25 minutes in the dark (cover plate with foil). After the incubation period, the wells were topped up with 100 μL of BD stain buffer and spun at 500×g for 3 minutes. The cells were washed 2× with 200 μL of BD stain buffer. Extracellular staining mastermix and FMO controls were prepared by diluting antibodies in BD stain buffer. 100 ul of the staining mix antibodies and the conjugated antibodies were added. The plate was incubated at 4° C. for 25 minutes in the dark (cover plate with foil). After the incubation period, the wells were topped up with 100 μL of BD stain buffer and spun at 500×g for 3 minutes. The supernatant was discarded by flicking off. The plate was washed 2× with 200 μL of BD stain buffer. After the second wash 100 μL of BD stain buffer was added. Signal was acquired on the NovoCyte. Files were saved and analyzed.

Example 22

CD34 Miltenyi MicroBeads Enrichment

Each donor was processed individually. The cells were collected and cell suspension was centrifuged at 400×g for 5 minutes. The cells were resuspended in 1 mL of complete TCM and transferred 10 μL each to 96 well U-bottom plate for counts. 190 μL of PBS was added (1:20 dilution of sample). Cells were counted using ViCELL-Blu.

The cells were topped up with 9 mL of cold PEF and centrifuged at 400×g for 5 minutes. Supernatant was aspirated completely. Cells were washed once with cold PEF buffer and resuspended in a final volume of 300 μL of cold PEF buffer for each (MOCK cells were not counted rested in IL-2 until REP).

Magnetic Labelling

50 μL kit of FcR Blocking Reagent was added for up to $10^8$ total cells. 50 μL of CD34 MicroBeads were added for up to $10^8$ total cells. 3. Mix was mixed well and incubated for 30 minutes in the refrigerator (2-8° C.). Cells were washed by adding 5 mL of buffer for up to $10^8$ cells and centrifuged at 400×g for 5 minutes. Supernatant was aspirated completely. Up to $10^8$ cells were resuspended in 500 μL of cold PEF buffer.

Magnetic Separation with MS Columns

MS column was placed in the magnetic field of the OctoMACS Separator. Column was prepared by rinsing with 500 μL of cold PEF buffer. Cell suspension was applied onto the column. Flow-through containing unlabelled cells was collected. Column was washed with 3×500 μL of cold PEF buffer. Unlabelled cells that pass through were collected and combined with the flow-through from step 3. Washing steps were performed by adding cold PEF buffer (4° C.) aliquots only when the column reservoir is empty. Column was removed from the separator and placed on a suitable pre-labelled collection tube. 1 mL of cold PEF buffer was pipeted onto the column. The magnetically labelled cells were immediately flushed out by firmly pushing the plunger into the column. (Optional) To increase the purity of CD34+ cells, the eluted fraction can be enriched over a second MS or LS Column. The magnetic separation procedure was repeated as described above by using a new column. Centrifuge at 400×g for 5 minutes. The supernatant was aspirated completely. The positive fraction was resuspended in 1 mL of complete pre-warmed TCM. Note: Take 10 μL of the stain cells pre-sort of each, 100 μL of the negative fraction and 20 μL of the positive fraction resuspended in TCM and stain cells in BD stain buffer with CD34− PE(0.5 μL/100 μL reaction) beads for 15 minutes at 4° C. After the incubation, 100 μL of BD stain buffer was used to top up and mix was centrifuged at 500×g for 3 minutes. The cells were resuspended in 100 μL of BD stain buffer with DRAQ7 (1:200 dilution) and 120 μL of each were acquired on the Novocyte 3005 to determine selection efficiency. Also, 20 μL each of the positive fractions was transferred to a 96 well U-bottom plate for counts. 180 μL of PBS (1:10 dilution of sample) was added. Cells were counted using ViCELL-Blu.

Example 23

Rapid Expansion Protocol Set Up Using the R+D Protocol (D12 Post Activation)

Materials and Methods

The rested MOCK or CD34 selected cells were counted using ViCELL-Blu (10 μL of each sample with 190 μL of PBS, 1:20 dilution) and cells were resuspended at a 1e6 cells/mL. Irradiated feeders were used. The cells were resuspended at a concentration of $1\times10^8$ cells/mL. T cells were resuspended in complete REP TIL TCM media with IL-2 and OKT3 cells at a density of $1\times10^6$/mL then transfer the to a 6-well G-REX wells. The G-Rex plate was placed in a humidified incubator 37° C.+5% CO2.

Every 2-3 days IL-2 was added to the wells. No further OKT3 was added after the first day Day 2 REP (15 days post activation) Added IL-2 2001 IU/mL to all REP cells. Day 4 REP (17 days post activation) IL-2 200 IU/mL was added to all REP cells. Day 6 REP (19 days post activation) On day 6, media was removed from each well. For 6-well G-REX 20 mL was removed from each well being careful not to disrupt the cells at the bottom of the well and replaced with fresh T-cell media. If the colour of the media changed to yellow before day 6 the media was refreshed earlier. After day 6 if the media colour did change to yellow, the media was refreshed again not forgetting to supplement with IL-2 200 IU/mL. If the pH of the media did not show any colour changes the media did not need to be changed again until the end of the rep. Day 8 REP 10 mL of media was removed from each well and 10 mL of Fresh media was added plus IL-2 (200 IU/mL). Day 11 REP IL-2 (200 IU/mL) was added. Day 14 REP (Day 26 post activation) Cells were collected and transferred to 50 mL falcon tubes. Cells were centrifuged at 400×g for 5 minutes. Cells were resuspended in 50 mL of TCM. 4. The cells were counted using ViCELL-Blu (10 μL of sample with 190 μL of PBS, 1:20 dilution). $1\times10^5$ cells were stained to assess phenotype and transduction. Remaining cells were frozen down to be used for co-culture. Cells frozen down to mimic previous process. Cells to be thawed and rested prior to co-culture with antigen presenting K562.luc.puro CEACAM5 or K562.luc.puro MSLN lines.

Example 24

Co-Culture with Cell Lines for Cytokine Secretion Analysis

Materials and Methods

For the co-culture an effector to target ratio of 8:1 (E:T, 1×10 cells:1.25×10$^4$ cells) was set up for the cell lines. T cells were resuspended at $1\times10^6$ cells/mL in complete TCM and 100 μL was used per well. For cell line targets, resuspended at 1.25×105 cells/mL in complete TCM and used 100 μL per well. T cells alone and targets alone were set up as negative controls. T cells stimulated with PMA (50 ng/mL)/Ionomycin (1 μg/mL) were set up as positive controls. T cells alone were topped up, targets alone and T cells were stimulated with PMA/I, with 100 μL per well. Final volume was 200 μL per well set up as triplicate. 7. The cells were incubated at 37° C. for 24 hours. 24 hours post incubation the plates were spun down at 400×g for 5 minutes. The supernatant was collected and distributed 80 μL aliquots of each into 2×96 well U-bottom plates. Supernatant was frozen at −80° C., 2 plate aliquots each.

Having thus described in detail preferred embodiments of the present invention, it is to be understood that the invention defined by the above paragraphs is not to be limited to particular details set forth in the above description as many apparent variations thereof are possible without departing from the spirit or scope of the present invention.

SEQUENCE LISTING (522 sequences)

SEQ ID NO: 1 - protein, 25 aa, Artificial Sequence
  Synthetic polypeptide
MGVLLTQRTLLSLVLALLFPSMASM

SEQ ID NO: 2 - protein, 21 aa, Artificial Sequence
  Synthetic polypeptide
MALPVTALLLPLALLLHAARP

SEQ ID NO: 3 - protein, 24 aa, Artificial Sequence
  Synthetic polypeptide
MSFPCKFVASFLLIFNVSSKGAVS

SEQ ID NO: 4 - protein, 20 aa, Artificial Sequence
  Synthetic polypeptide
MYRMQLLSCIALSLALVTNS

SEQ ID NO: 5 - protein, 17 aa, Artificial Sequence
  Synthetic polypeptide
MWLQSLLLLGTVACSIS

SEQ ID NO: 6 - protein, 20 aa, Artificial Sequence
  Synthetic polypeptide
MEAPAQLLFLLLLWLPDTTR

SEQ ID NO: 7 - protein, 25 aa, Artificial Sequence
  Synthetic polypeptide
MGVLLTQRTLLSLVLALLFPSMASM

SEQ ID NO: 8 - protein, 23 aa, Artificial Sequence
  Synthetic polypeptide
MQIPQAPWPVVWAVLQLGWRPGW

SEQ ID NO: 9 - protein, 244 aa, Artificial Sequence
  Synthetic polypeptide
QVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIK

SEQ ID NO: 10 - protein, 242 aa, Artificial Sequence
  Synthetic polypeptide
QVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKR

SEQ ID NO: 11 - protein, 242 aa, Artificial Sequence
  Synthetic polypeptide
QVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKR

SEQ ID NO: 12 - protein, 241 aa, Artificial Sequence
  Synthetic polypeptide
QVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIK

SEQ ID NO: 13 - protein, 246 aa, Artificial Sequence
  Synthetic polypeptide
QVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 14 - protein, 243 aa, Artificial Sequence
  Synthetic polypeptide
QLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKR

SEQ ID NO: 15 - protein, 247 aa, Artificial Sequence
  Synthetic polypeptide
EVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIK

SEQ ID NO: 16 - protein, 136 aa, Artificial Sequence
  Synthetic polypeptide
RPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAH

SEQ ID NO: 17 - protein, 120 aa, Artificial Sequence
  Synthetic polypeptide
MMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIP

SEQ ID NO: 18 - protein, 9 aa, Artificial Sequence
  Synthetic polypeptide
AAAGSGGSG

SEQ ID NO: 19 - protein, 159 aa, Artificial Sequence
  Synthetic polypeptide
ILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWV

SEQ ID NO: 20 - protein, 83 aa, Artificial Sequence
  Synthetic polypeptide
FVPVFLPAKPTTTPAPRPPTPAPTIASQPLSLRPEACRPAAGGAVHTRGLDFACDIYIWAPLAGTCGVLLLSLVITLYCNHRN

SEQ ID NO: 21 - protein, 27 aa, Artificial Sequence
  Synthetic polypeptide
FWVLVVVGGVLACYSLLVTVAFIIFWV

SEQ ID NO: 22 - protein, 39 aa, Artificial Sequence
  Synthetic polypeptide
CPSPLFPGPSKPFWVLVVVGGVLACYSLLVTVAFIIFWV

SEQ ID NO: 23 - protein, 48 aa, Artificial Sequence
  Synthetic polypeptide
IIHVKGKHLCPSPLFPGPSKPFWVLVVVGGVLACYSLLVTVAFIIFWV

SEQ ID NO: 24 - protein, 257 aa, Artificial Sequence
  Synthetic polypeptide
ESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWV

SEQ ID NO: 25 - protein, 41 aa, Artificial Sequence
  Synthetic polypeptide
RSKRSRLLHSDYMNMTPRRPGPTRKHYQPYAPPRDFAAYRS

SEQ ID NO: 26 - protein, 46 aa, Artificial Sequence
  Synthetic polypeptide
RFSVVKRGRKKLLYIFKQPFMRPVQTTQEEDGCSCRFPEEEEGGCE

SEQ ID NO: 27 - protein, 37 aa, Artificial Sequence
  Synthetic polypeptide
RRDQRLPPDAHKPPGGGSFRTPIQEEQADAHSTLAKI

SEQ ID NO: 28 - protein, 116 aa, Artificial Sequence
  Synthetic polypeptide
KRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 29 - protein, 58 aa, Artificial Sequence
  Synthetic polypeptide
QLGLHIWQLRSQCMWPRETQLLLEVPPSTEDARSCQFPEEERGERSAEEKGRLGDLWV

SEQ ID NO: 30 - protein, 47 aa, Artificial Sequence
  Synthetic polypeptide
KLLMIIHDRREFAKFEKEKMNAKWDTGENPIYKSAVTTVVNPKYEGK

SEQ ID NO: 31 - protein, 75 aa, Artificial Sequence
  Synthetic polypeptide
RRRGKTNHYQTTVEKKSLTIYAQVQKPGPLQKKLDSFPAQDPCTTIYVAATEPVPESVQETNSITVYASVTLPES

SEQ ID NO: 32 - protein, 62 aa, Artificial Sequence
  Synthetic polypeptide
KKVAKKPTNKAPHPKQEPQEINFPDDLPGSNTAAPVQETLHGCQPVTQEDGKESRISVQERQ

SEQ ID NO: 33 - protein, 125 aa, Artificial Sequence
  Synthetic polypeptide
AKKPTNKAPHPKQEPQEINFPDDLPGSNTAAPVQETLHGCQPVTQEDGKESRISVQERQKKVAKKPTNKAPHPKQEPQEINFPDDLPGSNTAAPVQETLHGCQPVTQEDGKESRISVQERQKKVA

SEQ ID NO: 34 - protein, 62 aa, Artificial Sequence
  Synthetic polypeptide
KKVAKKPTNKAAHPKQEPQEINFPDDLPGSNTAAPVQETLHGCQPVTQEDGKESRISVQERQ

SEQ ID NO: 35 - protein, 8 aa, Artificial Sequence
  Synthetic polypeptide
KPTNKAPH

SEQ ID NO: 36 - protein, 4 aa, Artificial Sequence
  Synthetic polypeptide
PKQE

SEQ ID NO: 37 - protein, 4 aa, Artificial Sequence
  Synthetic polypeptide
PVQE

SEQ ID NO: 38 - protein, 4 aa, Artificial Sequence
  Synthetic polypeptide
SVQE

SEQ ID NO: 39 - protein, 9 aa, Artificial Sequence
  Synthetic polypeptide
QEPQEINFP

SEQ ID NO: 40 - protein, 7 aa, Artificial Sequence
  Synthetic polypeptide
KKPTNKA

SEQ ID NO: 41 - protein, 7 aa, Artificial Sequence
  Synthetic polypeptide
SRISVQE

SEQ ID NO: 42 - protein, 538 aa, Artificial Sequence
  Synthetic polypeptide
MGVLLTQRTLLSLVLALLFPSMASMQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 43 - protein, 534 aa, Artificial Sequence
  Synthetic polypeptide
MALPVTALLLPLALLLHAARPQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 44 - protein, 537 aa, Artificial Sequence
  Synthetic polypeptide
MSFPCKFVASFLLIFNVSSKGAVSQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 45 - protein, 533 aa, Artificial Sequence
  Synthetic polypeptide
MYRMQLLSCIALSLALVTNSQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 46 - protein, 530 aa, Artificial Sequence
  Synthetic polypeptide
MWLQSLLLLGTVACSISQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 47 - protein, 533 aa, Artificial Sequence
  Synthetic polypeptide
MEAPAQLLFLLLLWLPDTTRQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 48 - protein, 462 aa, Artificial Sequence
  Synthetic polypeptide
MGVLLTQRTLLSLVLALLFPSMASMQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 49 - protein, 458 aa, Artificial Sequence
  Synthetic polypeptide
MALPVTALLLPLALLLHAARPQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 50 - protein, 461 aa, Artificial Sequence
  Synthetic polypeptide
MSFPCKFVASFLLIFNVSSKGAVSQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 51 - protein, 457 aa, Artificial Sequence
  Synthetic polypeptide
MYRMQLLSCIALSLALVTNSQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 52 - protein, 454 aa, Artificial Sequence
  Synthetic polypeptide
MWLQSLLLLGTVACSISQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 53 - protein, 457 aa, Artificial Sequence
  Synthetic polypeptide
MEAPAQLLFLLLLWLPDTTRQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 54 - protein, 406 aa, Artificial Sequence
  Synthetic polypeptide
MGVLLTQRTLLSLVLALLFPSMASMQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 55 - protein, 402 aa, Artificial Sequence
  Synthetic polypeptide
MALPVTALLLPLALLLHAARPQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 56 - protein, 405 aa, Artificial Sequence
  Synthetic polypeptide
MSFPCKFVASFLLIFNVSSKGAVSQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 57 - protein, 401 aa, Artificial Sequence
  Synthetic polypeptide
MYRMQLLSCIALSLALVTNSQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 58 - protein, 398 aa, Artificial Sequence
  Synthetic polypeptide
MWLQSLLLLGTVACSISQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 59 - protein, 401 aa, Artificial Sequence
  Synthetic polypeptide
MEAPAQLLFLLLLWLPDTTRQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 60 - protein, 538 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 61 - protein, 534 aa, Artificial Sequence
  Synthetic polypeptide
MALPVTALLLPLALLLHAARPQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 62 - protein, 537 aa, Artificial Sequence
  Synthetic polypeptide
MSFPCKFVASFLLIFNVSSKGAVSQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 63 - protein, 533 aa, Artificial Sequence
  Synthetic polypeptide
MYRMQLLSCIALSLALVTNSQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 64 - protein, 530 aa, Artificial Sequence
  Synthetic polypeptide
MWLQSLLLLGTVACSISQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 65 - protein, 533 aa, Artificial Sequence
  Synthetic polypeptide
MEAPAQLLFLLLLWLPDTTRQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 66 - protein, 462 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 67 - protein, 458 aa, Artificial Sequence
  Synthetic polypeptide
MALPVTALLLPLALLLHAARPQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 68 - protein, 461 aa, Artificial Sequence
  Synthetic polypeptide
MSFPCKFVASFLLIFNVSSKGAVSQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 69 - protein, 457 aa, Artificial Sequence
  Synthetic polypeptide
MYRMQLLSCIALSLALVTNSQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 70 - protein, 454 aa, Artificial Sequence
  Synthetic polypeptide
MWLQSLLLLGTVACSISQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 71 - protein, 457 aa, Artificial Sequence
  Synthetic polypeptide
MEAPAQLLFLLLLWLPDTTRQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 72 - protein, 406 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 73 - protein, 402 aa, Artificial Sequence
  Synthetic polypeptide
MALPVTALLLPLALLLHAARPQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 74 - protein, 405 aa, Artificial Sequence
  Synthetic polypeptide
MSFPCKFVASFLLIFNVSSKGAVSQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 75 - protein, 401 aa, Artificial Sequence
  Synthetic polypeptide
MYRMQLLSCIALSLALVTNSQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 76 - protein, 398 aa, Artificial Sequence
  Synthetic polypeptide
MWLQSLLLLGTVACSISQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 77 - protein, 401 aa, Artificial Sequence
  Synthetic polypeptide
MEAPAQLLFLLLLWLPDTTRQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 78 - protein, 537 aa, Artificial Sequence
  Synthetic polypeptide
MGVLLTQRTLLSLVLALLFPSMASMQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 79 - protein, 533 aa, Artificial Sequence
  Synthetic polypeptide
MALPVTALLLPLALLLHAARPQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 80 - protein, 536 aa, Artificial Sequence
  Synthetic polypeptide
MSFPCKFVASFLLIFNVSSKGAVSQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 81 - protein, 532 aa, Artificial Sequence
  Synthetic polypeptide
MYRMQLLSCIALSLALVTNSQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 82 - protein, 529 aa, Artificial Sequence
  Synthetic polypeptide
MWLQSLLLLGTVACSISQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 83 - protein, 532 aa, Artificial Sequence
  Synthetic polypeptide
MEAPAQLLFLLLLWLPDTTRQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 84 - protein, 461 aa, Artificial Sequence
  Synthetic polypeptide
MGVLLTQRTLLSLVLALLFPSMASMQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 85 - protein, 457 aa, Artificial Sequence
  Synthetic polypeptide
MALPVTALLLPLALLLHAARPQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 86 - protein, 460 aa, Artificial Sequence
  Synthetic polypeptide
MSFPCKFVASFLLIFNVSSKGAVSQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 87 - protein, 456 aa, Artificial Sequence
  Synthetic polypeptide
MYRMQLLSCIALSLALVTNSQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 88 - protein, 453 aa, Artificial Sequence
  Synthetic polypeptide
MWLQSLLLLGTVACSISQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 89 - protein, 456 aa, Artificial Sequence
  Synthetic polypeptide
MEAPAQLLFLLLLWLPDTTRQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 90 - protein, 405 aa, Artificial Sequence
  Synthetic polypeptide
MGVLLTQRTLLSLVLALLFPSMASMQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 91 - protein, 401 aa, Artificial Sequence
  Synthetic polypeptide
MALPVTALLLPLALLLHAARPQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 92 - protein, 404 aa, Artificial Sequence
  Synthetic polypeptide
MSFPCKFVASFLLIFNVSSKGAVSQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 93 - protein, 400 aa, Artificial Sequence
  Synthetic polypeptide
MYRMQLLSCIALSLALVTNSQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 94 - protein, 397 aa, Artificial Sequence
  Synthetic polypeptide
MWLQSLLLLGTVACSISQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 95 - protein, 400 aa, Artificial Sequence
  Synthetic polypeptide
MEAPAQLLFLLLLWLPDTTRQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 96 - protein, 542 aa, Artificial Sequence
  Synthetic polypeptide
MGVLLTQRTLLSLVLALLFPSMASMQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 97 - protein, 538 aa, Artificial Sequence
  Synthetic polypeptide
MALPVTALLLPLALLLHAARPQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 98 - protein, 541 aa, Artificial Sequence
  Synthetic polypeptide
MSFPCKFVASFLLIFNVSSKGAVSQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 99 - protein, 537 aa, Artificial Sequence
  Synthetic polypeptide
MYRMQLLSCIALSLALVTNSQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 100 - protein, 534 aa, Artificial Sequence
  Synthetic polypeptide
MWLQSLLLLGTVACSISQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 101 - protein, 537 aa, Artificial Sequence
  Synthetic polypeptide
MEAPAQLLFLLLLWLPDTTRQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 102 - protein, 466 aa, Artificial Sequence
  Synthetic polypeptide
MGVLLTQRTLLSLVLALLFPSMASMQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 103 - protein, 462 aa, Artificial Sequence
  Synthetic polypeptide
MALPVTALLLPLALLLHAARPQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 104 - protein, 465 aa, Artificial Sequence
  Synthetic polypeptide
MSFPCKFVASFLLIFNVSSKGAVSQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 105 - protein, 461 aa, Artificial Sequence
  Synthetic polypeptide
MYRMQLLSCIALSLALVTNSQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 106 - protein, 458 aa, Artificial Sequence
  Synthetic polypeptide
MWLQSLLLLGTVACSISQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 107 - protein, 461 aa, Artificial Sequence
  Synthetic polypeptide
MEAPAQLLFLLLLWLPDTTRQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 108 - protein, 410 aa, Artificial Sequence
  Synthetic polypeptide
MGVLLTQRTLLSLVLALLFPSMASMQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 109 - protein, 406 aa, Artificial Sequence
  Synthetic polypeptide
MALPVTALLLPLALLLHAARPQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 110 - protein, 409 aa, Artificial Sequence
  Synthetic polypeptide
MSFPCKFVASFLLIFNVSSKGAVSQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 111 - protein, 405 aa, Artificial Sequence
  Synthetic polypeptide
MYRMQLLSCIALSLALVTNSQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 112 - protein, 402 aa, Artificial Sequence
  Synthetic polypeptide
MWLQSLLLLGTVACSISQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 113 - protein, 405 aa, Artificial Sequence
  Synthetic polypeptide
MEAPAQLLFLLLLWLPDTTRQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 114 - protein, 539 aa, Artificial Sequence
  Synthetic polypeptide
MGVLLTQRTLLSLVLALLFPSMASMQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 115 - protein, 535 aa, Artificial Sequence
  Synthetic polypeptide
MALPVTALLLPLALLLHAARPQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 116 - protein, 538 aa, Artificial Sequence
  Synthetic polypeptide
MSFPCKFVASFLLIFNVSSKGAVSQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 117 - protein, 534 aa, Artificial Sequence
  Synthetic polypeptide
MYRMQLLSCIALSLALVTNSQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 118 - protein, 531 aa, Artificial Sequence
  Synthetic polypeptide
MWLQSLLLLGTVACSISQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 119 - protein, 534 aa, Artificial Sequence
  Synthetic polypeptide
MEAPAQLLFLLLLWLPDTTRQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 120 - protein, 463 aa, Artificial Sequence
  Synthetic polypeptide
MGVLLTQRTLLSLVLALLFPSMASMQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 121 - protein, 459 aa, Artificial Sequence
  Synthetic polypeptide
MALPVTALLLPLALLLHAARPQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 122 - protein, 462 aa, Artificial Sequence
  Synthetic polypeptide
MSFPCKFVASFLLIFNVSSKGAVSQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 123 - protein, 458 aa, Artificial Sequence
  Synthetic polypeptide
MYRMQLLSCIALSLALVTNSQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 124 - protein, 455 aa, Artificial Sequence
  Synthetic polypeptide
MWLQSLLLLGTVACSISQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 125 - protein, 458 aa, Artificial Sequence
  Synthetic polypeptide
MEAPAQLLFLLLLWLPDTTRQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 126 - protein, 407 aa, Artificial Sequence
  Synthetic polypeptide
MGVLLTQRTLLSLVLALLFPSMASMQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 127 - protein, 403 aa, Artificial Sequence
  Synthetic polypeptide
MALPVTALLLPLALLLHAARPQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 128 - protein, 406 aa, Artificial Sequence
  Synthetic polypeptide
MSFPCKFVASFLLIFNVSSKGAVSQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 129 - protein, 402 aa, Artificial Sequence
  Synthetic polypeptide
MYRMQLLSCIALSLALVTNSQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 130 - protein, 399 aa, Artificial Sequence
  Synthetic polypeptide
MWLQSLLLLGTVACSISQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 131 - protein, 402 aa, Artificial Sequence
  Synthetic polypeptide
MEAPAQLLFLLLLWLPDTTRQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 132 - protein, 543 aa, Artificial Sequence
  Synthetic polypeptide
MGVLLTQRTLLSLVLALLFPSMASMEVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 133 - protein, 539 aa, Artificial Sequence
  Synthetic polypeptide
MALPVTALLLPLALLLHAARPEVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 134 - protein, 542 aa, Artificial Sequence
  Synthetic polypeptide
MSFPCKFVASFLLIFNVSSKGAVSEVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 135 - protein, 538 aa, Artificial Sequence
  Synthetic polypeptide
MYRMQLLSCIALSLALVTNSEVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 136 - protein, 535 aa, Artificial Sequence
  Synthetic polypeptide
MWLQSLLLLGTVACSISEVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 137 - protein, 538 aa, Artificial Sequence
  Synthetic polypeptide
MEAPAQLLFLLLLWLPDTTREVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 138 - protein, 467 aa, Artificial Sequence
  Synthetic polypeptide
MGVLLTQRTLLSLVLALLFPSMASMEVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 139 - protein, 463 aa, Artificial Sequence
  Synthetic polypeptide
MALPVTALLLPLALLLHAARPEVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 140 - protein, 466 aa, Artificial Sequence
  Synthetic polypeptide
MSFPCKFVASFLLIFNVSSKGAVSEVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 141 - protein, 462 aa, Artificial Sequence
  Synthetic polypeptide
MYRMQLLSCIALSLALVTNSEVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 142 - protein, 459 aa, Artificial Sequence
  Synthetic polypeptide
MWLQSLLLLGTVACSISEVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 143 - protein, 462 aa, Artificial Sequence
  Synthetic polypeptide
MEAPAQLLFLLLLWLPDTTREVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 144 - protein, 411 aa, Artificial Sequence
  Synthetic polypeptide
MGVLLTQRTLLSLVLALLFPSMASMEVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 145 - protein, 407 aa, Artificial Sequence
  Synthetic polypeptide
MALPVTALLLPLALLLHAARPEVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 146 - protein, 410 aa, Artificial Sequence
  Synthetic polypeptide
MSFPCKFVASFLLIFNVSSKGAVSEVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 147 - protein, 406 aa, Artificial Sequence
  Synthetic polypeptide
MYRMQLLSCIALSLALVTNSEVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 148 - protein, 403 aa, Artificial Sequence
  Synthetic polypeptide
MWLQSLLLLGTVACSISEVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 149 - protein, 406 aa, Artificial Sequence
  Synthetic polypeptide
MEAPAQLLFLLLLWLPDTTREVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 150 - protein, 427 aa, Artificial Sequence
  Synthetic polypeptide
MGVLLTQRTLLSLVLALLFPSMASMQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 151 - protein, 423 aa, Artificial Sequence
  Synthetic polypeptide
MALPVTALLLPLALLLHAARPQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 152 - protein, 426 aa, Artificial Sequence
  Synthetic polypeptide
MSFPCKFVASFLLIFNVSSKGAVSQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 153 - protein, 422 aa, Artificial Sequence
  Synthetic polypeptide
MYRMQLLSCIALSLALVTNSQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 154 - protein, 419 aa, Artificial Sequence
  Synthetic polypeptide
MWLQSLLLLGTVACSISQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 155 - protein, 422 aa, Artificial Sequence
  Synthetic polypeptide
MEAPAQLLFLLLLWLPDTTRQVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 156 - protein, 427 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 157 - protein, 423 aa, Artificial Sequence
  Synthetic polypeptide
MALPVTALLLPLALLLHAARPQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 158 - protein, 426 aa, Artificial Sequence
  Synthetic polypeptide
MSFPCKFVASFLLIFNVSSKGAVSQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 159 - protein, 422 aa, Artificial Sequence
  Synthetic polypeptide
MYRMQLLSCIALSLALVTNSQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 160 - protein, 419 aa, Artificial Sequence
  Synthetic polypeptide
MWLQSLLLLGTVACSISQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 161 - protein, 422 aa, Artificial Sequence
  Synthetic polypeptide
MEAPAQLLFLLLLWLPDTTRQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 162 - protein, 426 aa, Artificial Sequence
  Synthetic polypeptide
MGVLLTQRTLLSLVLALLFPSMASMQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 163 - protein, 422 aa, Artificial Sequence
  Synthetic polypeptide
MALPVTALLLPLALLLHAARPQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 164 - protein, 425 aa, Artificial Sequence
  Synthetic polypeptide
MSFPCKFVASFLLIFNVSSKGAVSQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 165 - protein, 421 aa, Artificial Sequence
  Synthetic polypeptide
MYRMQLLSCIALSLALVTNSQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 166 - protein, 418 aa, Artificial Sequence
  Synthetic polypeptide
MWLQSLLLLGTVACSISQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 167 - protein, 421 aa, Artificial Sequence
  Synthetic polypeptide
MEAPAQLLFLLLLWLPDTTRQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 168 - protein, 431 aa, Artificial Sequence
  Synthetic polypeptide
MGVLLTQRTLLSLVLALLFPSMASMQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 169 - protein, 427 aa, Artificial Sequence
  Synthetic polypeptide
MALPVTALLLPLALLLHAARPQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 170 - protein, 430 aa, Artificial Sequence
  Synthetic polypeptide
MSFPCKFVASFLLIFNVSSKGAVSQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 171 - protein, 426 aa, Artificial Sequence
  Synthetic polypeptide
MYRMQLLSCIALSLALVTNSQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 172 - protein, 423 aa, Artificial Sequence
  Synthetic polypeptide
MWLQSLLLLGTVACSISQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 173 - protein, 426 aa, Artificial Sequence
  Synthetic polypeptide
MEAPAQLLFLLLLWLPDTTRQVQLVQSGAEVKKPGSSVKVSCKASGGTFSNSPINWLRQAPGQGLEWMGSIIPSFGTANYAQKFQGRLTITADESTSTAYMELSSLRSEDTAVYYCAGRSHNYELYYYYMDVWGQGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 174 - protein, 428 aa, Artificial Sequence
  Synthetic polypeptide
MGVLLTQRTLLSLVLALLFPSMASMQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 175 - protein, 424 aa, Artificial Sequence
  Synthetic polypeptide
MALPVTALLLPLALLLHAARPQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 176 - protein, 427 aa, Artificial Sequence
  Synthetic polypeptide
MSFPCKFVASFLLIFNVSSKGAVSQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 177 - protein, 423 aa, Artificial Sequence
  Synthetic polypeptide
MYRMQLLSCIALSLALVTNSQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 178 - protein, 420 aa, Artificial Sequence
  Synthetic polypeptide
MWLQSLLLLGTVACSISQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 179 - protein, 423 aa, Artificial Sequence
  Synthetic polypeptide
MEAPAQLLFLLLLWLPDTTRQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSGGGGSGGGGSGGGGSGVHSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 180 - protein, 432 aa, Artificial Sequence
  Synthetic polypeptide
MGVLLTQRTLLSLVLALLFPSMASMEVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 181 - protein, 428 aa, Artificial Sequence
  Synthetic polypeptide
MALPVTALLLPLALLLHAARPEVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 182 - protein, 431 aa, Artificial Sequence
  Synthetic polypeptide
MSFPCKFVASFLLIFNVSSKGAVSEVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 183 - protein, 427 aa, Artificial Sequence
  Synthetic polypeptide
MYRMQLLSCIALSLALVTNSEVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 184 - protein, 424 aa, Artificial Sequence
  Synthetic polypeptide
MWLQSLLLLGTVACSISEVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 185 - protein, 427 aa, Artificial Sequence
  Synthetic polypeptide
MEAPAQLLFLLLLWLPDTTREVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSGGGGSGGGGSGGGGSDIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 186 - protein, 240 aa, Artificial Sequence
  Synthetic polypeptide
QVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIK

SEQ ID NO: 187 - protein, 236 aa, Artificial Sequence
  Synthetic polypeptide
QVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIK

SEQ ID NO: 188 - protein, 241 aa, Artificial Sequence
  Synthetic polypeptide
QVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIK

SEQ ID NO: 189 - protein, 241 aa, Artificial Sequence
  Synthetic polypeptide
QVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIK

SEQ ID NO: 190 - protein, 249 aa, Artificial Sequence
  Synthetic polypeptide
EVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEI

SEQ ID NO: 191 - protein, 254 aa, Artificial Sequence
  Synthetic polypeptide
QVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLS

SEQ ID NO: 192 - protein, 536 aa, Artificial Sequence
  Synthetic polypeptide
MGVLLTQRTLLSLVLALLFPSMASMQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 193 - protein, 532 aa, Artificial Sequence
  Synthetic polypeptide
MALPVTALLLPLALLLHAARPQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 194 - protein, 535 aa, Artificial Sequence
  Synthetic polypeptide
MSFPCKFVASFLLIFNVSSKGAVSQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 195 - protein, 531 aa, Artificial Sequence
  Synthetic polypeptide
MYRMQLLSCIALSLALVTNSQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 196 - protein, 528 aa, Artificial Sequence
  Synthetic polypeptide
MWLQSLLLLGTVACSISQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 197 - protein, 531 aa, Artificial Sequence
  Synthetic polypeptide
MEAPAQLLFLLLLWLPDTTRQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 198 - protein, 460 aa, Artificial Sequence
  Synthetic polypeptide
MGVLLTQRTLLSLVLALLFPSMASMQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 199 - protein, 456 aa, Artificial Sequence
  Synthetic polypeptide
MALPVTALLLPLALLLHAARPQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 200 - protein, 459 aa, Artificial Sequence
  Synthetic polypeptide
MSFPCKFVASFLLIFNVSSKGAVSQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 201 - protein, 455 aa, Artificial Sequence
  Synthetic polypeptide
MYRMQLLSCIALSLALVTNSQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 202 - protein, 452 aa, Artificial Sequence
  Synthetic polypeptide
MWLQSLLLLGTVACSISQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 203 - protein, 455 aa, Artificial Sequence
  Synthetic polypeptide
MEAPAQLLFLLLLWLPDTTRQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 204 - protein, 404 aa, Artificial Sequence
  Synthetic polypeptide
MGVLLTQRTLLSLVLALLFPSMASMQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 205 - protein, 400 aa, Artificial Sequence
  Synthetic polypeptide
MALPVTALLLPLALLLHAARPQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 206 - protein, 403 aa, Artificial Sequence
  Synthetic polypeptide
MSFPCKFVASFLLIFNVSSKGAVSQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 207 - protein, 399 aa, Artificial Sequence
  Synthetic polypeptide
MYRMQLLSCIALSLALVTNSQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 208 - protein, 396 aa, Artificial Sequence
  Synthetic polypeptide
MWLQSLLLLGTVACSISQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 209 - protein, 399 aa, Artificial Sequence
  Synthetic polypeptide
MEAPAQLLFLLLLWLPDTTRQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 210 - protein, 532 aa, Artificial Sequence
  Synthetic polypeptide
MGVLLTQRTLLSLVLALLFPSMASMQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 211 - protein, 528 aa, Artificial Sequence
  Synthetic polypeptide
MALPVTALLLPLALLLHAARPQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 212 - protein, 531 aa, Artificial Sequence
  Synthetic polypeptide
MSFPCKFVASFLLIFNVSSKGAVSQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 213 - protein, 527 aa, Artificial Sequence
  Synthetic polypeptide
MYRMQLLSCIALSLALVTNSQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 214 - protein, 524 aa, Artificial Sequence
  Synthetic polypeptide
MWLQSLLLLGTVACSISQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 215 - protein, 527 aa, Artificial Sequence
  Synthetic polypeptide
MEAPAQLLFLLLLWLPDTTRQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 216 - protein, 456 aa, Artificial Sequence
  Synthetic polypeptide
MGVLLTQRTLLSLVLALLFPSMASMQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 217 - protein, 452 aa, Artificial Sequence
  Synthetic polypeptide
MALPVTALLLPLALLLHAARPQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 218 - protein, 455 aa, Artificial Sequence
  Synthetic polypeptide
MSFPCKFVASFLLIFNVSSKGAVSQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 219 - protein, 451 aa, Artificial Sequence
  Synthetic polypeptide
MYRMQLLSCIALSLALVTNSQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 220 - protein, 448 aa, Artificial Sequence
  Synthetic polypeptide
MWLQSLLLLGTVACSISQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 221 - protein, 451 aa, Artificial Sequence
  Synthetic polypeptide
MEAPAQLLFLLLLWLPDTTRQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 222 - protein, 400 aa, Artificial Sequence
  Synthetic polypeptide
MGVLLTQRTLLSLVLALLFPSMASMQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 223 - protein, 396 aa, Artificial Sequence
  Synthetic polypeptide
MALPVTALLLPLALLLHAARPQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 224 - protein, 399 aa, Artificial Sequence
  Synthetic polypeptide
MSFPCKFVASFLLIFNVSSKGAVSQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 225 - protein, 395 aa, Artificial Sequence
  Synthetic polypeptide
MYRMQLLSCIALSLALVTNSQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 226 - protein, 392 aa, Artificial Sequence
  Synthetic polypeptide
MWLQSLLLLGTVACSISQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 227 - protein, 395 aa, Artificial Sequence
  Synthetic polypeptide
MEAPAQLLFLLLLWLPDTTRQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 228 - protein, 537 aa, Artificial Sequence
  Synthetic polypeptide
MGVLLTQRTLLSLVLALLFPSMASMQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 229 - protein, 533 aa, Artificial Sequence
  Synthetic polypeptide
MALPVTALLLPLALLLHAARPQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 230 - protein, 536 aa, Artificial Sequence
  Synthetic polypeptide
MSFPCKFVASFLLIFNVSSKGAVSQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 231 - protein, 532 aa, Artificial Sequence
  Synthetic polypeptide
MYRMQLLSCIALSLALVTNSQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 232 - protein, 529 aa, Artificial Sequence
  Synthetic polypeptide
MWLQSLLLLGTVACSISQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 233 - protein, 532 aa, Artificial Sequence
  Synthetic polypeptide
MEAPAQLLFLLLLWLPDTTRQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 234 - protein, 461 aa, Artificial Sequence
  Synthetic polypeptide
MGVLLTQRTLLSLVLALLFPSMASMQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 235 - protein, 457 aa, Artificial Sequence
  Synthetic polypeptide
MALPVTALLLPLALLLHAARPQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 236 - protein, 460 aa, Artificial Sequence
  Synthetic polypeptide
MSFPCKFVASFLLIFNVSSKGAVSQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 237 - protein, 456 aa, Artificial Sequence
  Synthetic polypeptide
MYRMQLLSCIALSLALVTNSQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 238 - protein, 453 aa, Artificial Sequence
  Synthetic polypeptide
MWLQSLLLLGTVACSISQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 239 - protein, 456 aa, Artificial Sequence
  Synthetic polypeptide
MEAPAQLLFLLLLWLPDTTRQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 240 - protein, 508 aa, Artificial Sequence
  Synthetic polypeptide
MGVLLTQRTLLSLVLALLFPSMASMQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 241 - protein, 401 aa, Artificial Sequence
  Synthetic polypeptide
MALPVTALLLPLALLLHAARPQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 242 - protein, 404 aa, Artificial Sequence
  Synthetic polypeptide
MSFPCKFVASFLLIFNVSSKGAVSQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 243 - protein, 400 aa, Artificial Sequence
  Synthetic polypeptide
MYRMQLLSCIALSLALVTNSQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 244 - protein, 397 aa, Artificial Sequence
  Synthetic polypeptide
MWLQSLLLLGTVACSISQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 245 - protein, 400 aa, Artificial Sequence
  Synthetic polypeptide
MEAPAQLLFLLLLWLPDTTRQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 246 - protein, 537 aa, Artificial Sequence
  Synthetic polypeptide
MGVLLTQRTLLSLVLALLFPSMASMQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 247 - protein, 533 aa, Artificial Sequence
  Synthetic polypeptide
MALPVTALLLPLALLLHAARPQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 248 - protein, 536 aa, Artificial Sequence
  Synthetic polypeptide
MSFPCKFVASFLLIFNVSSKGAVSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 249 - protein, 532 aa, Artificial Sequence
  Synthetic polypeptide
MYRMQLLSCIALSLALVTNSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 250 - protein, 529 aa, Artificial Sequence
  Synthetic polypeptide
MWLQSLLLLGTVACSISQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 251 - protein, 532 aa, Artificial Sequence
  Synthetic polypeptide
MEAPAQLLFLLLLWLPDTTRQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 252 - protein, 461 aa, Artificial Sequence
  Synthetic polypeptide
MGVLLTQRTLLSLVLALLFPSMASMQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 253 - protein, 457 aa, Artificial Sequence
  Synthetic polypeptide
MALPVTALLLPLALLLHAARPQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 254 - protein, 460 aa, Artificial Sequence
  Synthetic polypeptide
MSFPCKFVASFLLIFNVSSKGAVSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 255 - protein, 456 aa, Artificial Sequence
  Synthetic polypeptide
MYRMQLLSCIALSLALVTNSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 256 - protein, 453 aa, Artificial Sequence
  Synthetic polypeptide
MWLQSLLLLGTVACSISQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 257 - protein, 456 aa, Artificial Sequence
  Synthetic polypeptide
MEAPAQLLFLLLLWLPDTTRQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 258 - protein, 405 aa, Artificial Sequence
  Synthetic polypeptide
MGVLLTQRTLLSLVLALLFPSMASMQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 259 - protein, 401 aa, Artificial Sequence
  Synthetic polypeptide
MALPVTALLLPLALLLHAARPQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 260 - protein, 404 aa, Artificial Sequence
  Synthetic polypeptide
MSFPCKFVASFLLIFNVSSKGAVSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 261 - protein, 400 aa, Artificial Sequence
  Synthetic polypeptide
MYRMQLLSCIALSLALVTNSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 262 - protein, 397 aa, Artificial Sequence
  Synthetic polypeptide
MWLQSLLLLGTVACSISQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 263 - protein, 400 aa, Artificial Sequence
  Synthetic polypeptide
MEAPAQLLFLLLLWLPDTTRQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 264 - protein, 545 aa, Artificial Sequence
  Synthetic polypeptide
MGVLLTQRTLLSLVLALLFPSMASMEVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 265 - protein, 541 aa, Artificial Sequence
  Synthetic polypeptide
MALPVTALLLPLALLLHAARPEVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 266 - protein, 544 aa, Artificial Sequence
  Synthetic polypeptide
MSFPCKFVASFLLIFNVSSKGAVSEVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 267 - protein, 540 aa, Artificial Sequence
  Synthetic polypeptide
MYRMQLLSCIALSLALVTNSEVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 268 - protein, 537 aa, Artificial Sequence
  Synthetic polypeptide
MWLQSLLLLGTVACSISEVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 269 - protein, 540 aa, Artificial Sequence
  Synthetic polypeptide
MEAPAQLLFLLLLWLPDTTREVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 270 - protein, 469 aa, Artificial Sequence
  Synthetic polypeptide
MGVLLTQRTLLSLVLALLFPSMASMEVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 271 - protein, 465 aa, Artificial Sequence
  Synthetic polypeptide
MALPVTALLLPLALLLHAARPEVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 272 - protein, 468 aa, Artificial Sequence
  Synthetic polypeptide
MSFPCKFVASFLLIFNVSSKGAVSEVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 273 - protein, 464 aa, Artificial Sequence
  Synthetic polypeptide
MYRMQLLSCIALSLALVTNSEVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 274 - protein, 461 aa, Artificial Sequence
  Synthetic polypeptide
MWLQSLLLLGTVACSISEVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 275 - protein, 464 aa, Artificial Sequence
  Synthetic polypeptide
MEAPAQLLFLLLLWLPDTTREVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 276 - protein, 413 aa, Artificial Sequence
  Synthetic polypeptide
MGVLLTQRTLLSLVLALLFPSMASMEVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 277 - protein, 409 aa, Artificial Sequence
  Synthetic polypeptide
MALPVTALLLPLALLLHAARPEVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 278 - protein, 412 aa, Artificial Sequence
  Synthetic polypeptide
MSFPCKFVASFLLIFNVSSKGAVSEVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 279 - protein, 408 aa, Artificial Sequence
  Synthetic polypeptide
MYRMQLLSCIALSLALVTNSEVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 280 - protein, 405 aa, Artificial Sequence
  Synthetic polypeptide
MWLQSLLLLGTVACSISEVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 281 - protein, 408 aa, Artificial Sequence
  Synthetic polypeptide
MEAPAQLLFLLLLWLPDTTREVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 282 - protein, 550 aa, Artificial Sequence
  Synthetic polypeptide
MGVLLTQRTLLSLVLALLFPSMASMQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 283 - protein, 546 aa, Artificial Sequence
  Synthetic polypeptide
MALPVTALLLPLALLLHAARPQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 284 - protein, 549 aa, Artificial Sequence
  Synthetic polypeptide
MSFPCKFVASFLLIFNVSSKGAVSQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 285 - protein, 545 aa, Artificial Sequence
  Synthetic polypeptide
MYRMQLLSCIALSLALVTNSQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 286 - protein, 542 aa, Artificial Sequence
  Synthetic polypeptide
MWLQSLLLLGTVACSISQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 287 - protein, 545 aa, Artificial Sequence
  Synthetic polypeptide
MEAPAQLLFLLLLWLPDTTRQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 288 - protein, 474 aa, Artificial Sequence
  Synthetic polypeptide
MGVLLTQRTLLSLVLALLFPSMASMQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 289 - protein, 470 aa, Artificial Sequence
  Synthetic polypeptide
MALPVTALLLPLALLLHAARPQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 290 - protein, 473 aa, Artificial Sequence
  Synthetic polypeptide
MSFPCKFVASFLLIFNVSSKGAVSQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 291 - protein, 469 aa, Artificial Sequence
  Synthetic polypeptide
MYRMQLLSCIALSLALVTNSQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 292 - protein, 466 aa, Artificial Sequence
  Synthetic polypeptide
MWLQSLLLLGTVACSISQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 293 - protein, 469 aa, Artificial Sequence
  Synthetic polypeptide
MEAPAQLLFLLLLWLPDTTRQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 294 - protein, 418 aa, Artificial Sequence
  Synthetic polypeptide
MGVLLTQRTLLSLVLALLFPSMASMQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 295 - protein, 414 aa, Artificial Sequence
  Synthetic polypeptide
MALPVTALLLPLALLLHAARPQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 296 - protein, 417 aa, Artificial Sequence
  Synthetic polypeptide
MSFPCKFVASFLLIFNVSSKGAVSQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 297 - protein, 413 aa, Artificial Sequence
  Synthetic polypeptide
MYRMQLLSCIALSLALVTNSQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 298 - protein, 410 aa, Artificial Sequence
  Synthetic polypeptide
MWLQSLLLLGTVACSISQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 299 - protein, 413 aa, Artificial Sequence
  Synthetic polypeptide
MEAPAQLLFLLLLWLPDTTRQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 300 - protein, 425 aa, Artificial Sequence
  Synthetic polypeptide
MGVLLTQRTLLSLVLALLFPSMASMQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 301 - protein, 421 aa, Artificial Sequence
  Synthetic polypeptide
MALPVTALLLPLALLLHAARPQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 302 - protein, 424 aa, Artificial Sequence
  Synthetic polypeptide
MSFPCKFVASFLLIFNVSSKGAVSQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 303 - protein, 420 aa, Artificial Sequence
  Synthetic polypeptide
MYRMQLLSCIALSLALVTNSQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 304 - protein, 417 aa, Artificial Sequence
  Synthetic polypeptide
MWLQSLLLLGTVACSISQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 305 - protein, 420 aa, Artificial Sequence
  Synthetic polypeptide
MEAPAQLLFLLLLWLPDTTRQVQLQQSGPELEKPGASVKLSCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 306 - protein, 421 aa, Artificial Sequence
  Synthetic polypeptide
MGVLLTQRTLLSLVLALLFPSMASMQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 307 - protein, 417 aa, Artificial Sequence
  Synthetic polypeptide
MALPVTALLLPLALLLHAARPQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 308 - protein, 420 aa, Artificial Sequence
  Synthetic polypeptide
MSFPCKFVASFLLIFNVSSKGAVSQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 309 - protein, 416 aa, Artificial Sequence
  Synthetic polypeptide
MYRMQLLSCIALSLALVTNSQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 310 - protein, 413 aa, Artificial Sequence
  Synthetic polypeptide
MWLQSLLLLGTVACSISQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 311 - protein, 416 aa, Artificial Sequence
  Synthetic polypeptide
MEAPAQLLFLLLLWLPDTTRQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 312 - protein, 426 aa, Artificial Sequence
  Synthetic polypeptide
MGVLLTQRTLLSLVLALLFPSMASMQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 313 - protein, 422 aa, Artificial Sequence
  Synthetic polypeptide
MALPVTALLLPLALLLHAARPQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 314 - protein, 425 aa, Artificial Sequence
  Synthetic polypeptide
MSFPCKFVASFLLIFNVSSKGAVSQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 315 - protein, 421 aa, Artificial Sequence
  Synthetic polypeptide
MYRMQLLSCIALSLALVTNSQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 316 - protein, 418 aa, Artificial Sequence
  Synthetic polypeptide
MWLQSLLLLGTVACSISQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 317 - protein, 421 aa, Artificial Sequence
  Synthetic polypeptide
MEAPAQLLFLLLLWLPDTTRQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 318 - protein, 426 aa, Artificial Sequence
  Synthetic polypeptide
MGVLLTQRTLLSLVLALLFPSMASMQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 319 - protein, 422 aa, Artificial Sequence
  Synthetic polypeptide
MALPVTALLLPLALLLHAARPQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 320 - protein, 425 aa, Artificial Sequence
  Synthetic polypeptide
MSFPCKFVASFLLIFNVSSKGAVSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 321 - protein, 421 aa, Artificial Sequence
  Synthetic polypeptide
MYRMQLLSCIALSLALVTNSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 322 - protein, 418 aa, Artificial Sequence
  Synthetic polypeptide
MWLQSLLLLGTVACSISQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 323 - protein, 421 aa, Artificial Sequence
  Synthetic polypeptide
MEAPAQLLFLLLLWLPDTTRQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGGSGGGGSGGGGSDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 324 - protein, 434 aa, Artificial Sequence
  Synthetic polypeptide
MGVLLTQRTLLSLVLALLFPSMASMEVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 325 - protein, 430 aa, Artificial Sequence
  Synthetic polypeptide
MALPVTALLLPLALLLHAARPEVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 326 - protein, 433 aa, Artificial Sequence
  Synthetic polypeptide
MSFPCKFVASFLLIFNVSSKGAVSEVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 327 - protein, 429 aa, Artificial Sequence
  Synthetic polypeptide
MYRMQLLSCIALSLALVTNSEVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 328 - protein, 426 aa, Artificial Sequence
  Synthetic polypeptide
MWLQSLLLLGTVACSISEVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 329 - protein, 429 aa, Artificial Sequence
  Synthetic polypeptide
MEAPAQLLFLLLLWLPDTTREVQLVESGGGLVQPGGSLRLSCAASGFDLGFYFYACWVRQAPGKGLEWVSCIYTAGSGSTYYASWAKGRFTISRDNSKNTLYLQMNSLRAEDTAVYYCARSTANTRSTYYLNLWGQGTLVTVSSGGGGSGGGGSGGGGSDIQMTQSPSSLSASVGDRVTITCQASQRISSYLSWYQQKPGKVPKLLIYGASTLASGVPSRFSGSGSGTDFTLTISSLQPEDVATYYCQSYAYFDSNNWHAFGGGTKVEIAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 330 - protein, 439 aa, Artificial Sequence
  Synthetic polypeptide
MGVLLTQRTLLSLVLALLFPSMASMQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 331 - protein, 435 aa, Artificial Sequence
  Synthetic polypeptide
MALPVTALLLPLALLLHAARPQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 332 - protein, 438 aa, Artificial Sequence
  Synthetic polypeptide
MSFPCKFVASFLLIFNVSSKGAVSQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 333 - protein, 434 aa, Artificial Sequence
  Synthetic polypeptide
MYRMQLLSCIALSLALVTNSQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 334 - protein, 431 aa, Artificial Sequence
  Synthetic polypeptide
MWLQSLLLLGTVACSISQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 335 - protein, 434 aa, Artificial Sequence
  Synthetic polypeptide
MEAPAQLLFLLLLWLPDTTRQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSAAAGSGGSGIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 336 - protein, 357 aa, Artificial Sequence
  Synthetic polypeptide
NKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 337 - protein, 199 aa, Artificial Sequence
  Synthetic polypeptide
MKSGLWYFFLFLCRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 338 - protein, 38 aa, Artificial Sequence
  Synthetic polypeptide
CWLTKKKYSSSVHDPNGEYMFMRAVNTAKKSRLTDVTL

SEQ ID NO: 339 - protein, 322 aa, Artificial Sequence
  Synthetic polypeptide
RDNETIWGVLGHGITLNIPNFQMTDDIDEVRWVRRGTLVAEFKRKKPPFLISETYEVLANGSLKIKKPMMRNDSGTYNVMVYGTNGMTRLEKDLDVRILERVSKPMIHWECPNTTLTCAVLQGTDFELKLYQGETLLNSLPQKNMSYQWTNLNAPFKCEAINPVSKESKMEVVNCPEKGLSFYVTVGVGAGGLLLVLLVALFIFCICKRRKRNRRRKDEELEIKASRTSTVERGPKPHSTPAAAAQNSVALQAPPPPGHHLQTPGHRPLPPGHRTREHQQKKRPPPSGTQIHQQKGPPLPRPRVQPKPPCGSGDGVSLPPPN

SEQ ID NO: 340 - protein, 115 aa, Artificial Sequence
  Synthetic polypeptide
KRRKRNRRRKDEELEIKASRTSTVERGPKPHSTPAAAAQNSVALQAPPPPGHHLQTPGHRPLPPGHRTREHQQKKRPPPSGTQIHQQKGPPLPRPRVQPKPPCGSGDGVSLPPPN

SEQ ID NO: 341 - protein, 42 aa, Artificial Sequence
  Synthetic polypeptide
KRGRKKLLYIFKQPFMRPVQTTQEEDGCSCRFPEEEEGGCEL

SEQ ID NO: 342 - protein, 24 aa, Artificial Sequence
  Synthetic polypeptide
LCARPRRSPAQEDGKVYINMPGRG

SEQ ID NO: 343 - protein, 42 aa, Artificial Sequence
  Synthetic polypeptide
ALYLLRRDQRLPPDAHKPPGGGSFRTPIQEEQADAHSTLAKI

SEQ ID NO: 344 - protein, 791 aa, Artificial Sequence
  Synthetic polypeptide
MGVLLTQRTLLSLVLALLFPSMASMQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 345 - protein, 853 aa, Artificial Sequence
  Synthetic polypeptide
MGVLLTQRTLLSLVLALLFPSMASMQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLGKKVAKKPTNKAPHPKQEPQEINFPDDLPGSNTAAPVQETLHGCQPVTQEDGKESRISVQERQ

SEQ ID NO: 346 - protein, 832 aa, Artificial Sequence
  Synthetic polypeptide
MGVLLTQRTLLSLVLALLFPSMASMQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 347 - protein, 894 aa, Artificial Sequence
  Synthetic polypeptide
MGVLLTQRTLLSLVLALLFPSMASMQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLGKKVAKKPTNKAPHPKQEPQEINFPDDLPGSNTAAPVQETLHGCQPVTQEDGKESRISVQERQ

SEQ ID NO: 348 - protein, 517 aa, Artificial Sequence
  Synthetic polypeptide
MGVLLTQRTLLSLVLALLFPSMASMQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTLKKVAKKPTNKAPHPKQEPQEINFPDDLPGSNTAAPVQETLHGCQPVTQEDGKESRISVQERQ

SEQ ID NO: 349 - protein, 513 aa, Artificial Sequence
  Synthetic polypeptide
MGVLLTQRTLLSLVLALLFPSMASMQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSCWLTKKKYSSSVHDPNGEYMFMRAVNTAKKSRLTDVTL

SEQ ID NO: 350 - protein, 575 aa, Artificial Sequence
  Synthetic polypeptide
MGVLLTQRTLLSLVLALLFPSMASMQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSCWLTKKKYSSSVHDPNGEYMFMRAVNTAKKSRLTDVTLKKVAKKPTNKAPHPKQEPQEINFPDDLPGSNTAAPVQETLHGCQPVTQEDGKESRISVQERQ

SEQ ID NO: 351 - protein, 659 aa, Artificial Sequence
  Synthetic polypeptide
MGVLLTQRTLLSLVLALLFPSMASMQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGRDNETIWGVLGHGITLNIPNFQMTDDIDEVRWVRRGTLVAEFKRKKPPFLISETYEVLANGSLKIKKPMMRNDSGTYNVMVYGTNGMTRLEKDLDVRILERVSKPMIHWECPNTTLTCAVLQGTDFELKLYQGETLLNSLPQKNMSYQWTNLNAPFKCEAINPVSKESKMEVVNCPEKGLSFYVTVGVGAGGLLLVLLVALFIFCICKRRKRNRRRKDEELEIKASRTSTVERGPKPHSTPAAAAQNSVALQAPPPPGHHLQTPGHRPLPPGHRTREHQQKKRPPPSGTQIHQQKGPPLPRPRVQPKPPCGSGDGVSLPPPNKKVAKKPTNKAPHPKQEPQEINFPDDLPGSNTAAPVQETLHGCQPVTQEDGKESRISVQERQ

SEQ ID NO: 352 - protein, 590 aa, Artificial Sequence
  Synthetic polypeptide
MGVLLTQRTLLSLVLALLFPSMASMQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKRRKRNRRRKDEELEIKASRTSTVERGPKPHSTPAAAAQNSVALQAPPPPGHHLQTPGHRPLPPGHRTREHQQKKRPPPSGTQIHQQKGPPLPRPRVQPKPPCGSGDGVSLPPPN

SEQ ID NO: 353 - protein, 652 aa, Artificial Sequence
  Synthetic polypeptide
MGVLLTQRTLLSLVLALLFPSMASMQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQKRRKRNRRRKDEELEIKASRTSTVERGPKPHSTPAAAAQNSVALQAPPPPGHHLQTPGHRPLPPGHRTREHQQKKRPPPSGTQIHQQKGPPLPRPRVQPKPPCGSGDGVSLPPPN

SEQ ID NO: 354 - protein, 517 aa, Artificial Sequence
  Synthetic polypeptide
MGVLLTQRTLLSLVLALLFPSMASMQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCEL

SEQ ID NO: 355 - protein, 579 aa, Artificial Sequence
  Synthetic polypeptide
MGVLLTQRTLLSLVLALLFPSMASMQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQKRGRKKLLYIFKQPFMRPVQTTQEEDGCSCRFPEEEEGGCEL

SEQ ID NO: 356 - protein, 499 aa, Artificial Sequence
  Synthetic polypeptide
MGVLLTQRTLLSLVLALLFPSMASMQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSLCARPRRSPAQEDGKVYINMPGRG

SEQ ID NO: 357 - protein, 561 aa, Artificial Sequence
  Synthetic polypeptide
MGVLLTQRTLLSLVLALLFPSMASMQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQLCARPRRSPAQEDGKVYINMPGRG

SEQ ID NO: 358 - protein, 517 aa, Artificial Sequence
  Synthetic polypeptide
MGVLLTQRTLLSLVLALLFPSMASMQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSALYLLRRDQRLPPDAHKPPGGGSFRTPIQEEQADAHSTLAKI

SEQ ID NO: 359 - protein, 579 aa, Artificial Sequence
  Synthetic polypeptide
MGVLLTQRTLLSLVLALLFPSMASMQVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQALYLLRRDQRLPPDAHKPPGGGSFRTPIQEEQADAHSTLAKI

SEQ ID NO: 360 - protein, 295 aa, Artificial Sequence
  Synthetic polypeptide
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 361 - protein, 538 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRIAVQARQ

SEQ ID NO: 362 - protein, 538 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAAVAEALHGCQPVTQEDGKESRISVQERQ

SEQ ID NO: 363 - protein, 538 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEAQAINFPDDLPGSNTAAPVQETLHGCQPVTQEDGKESRISVQERQ

SEQ ID NO: 364 - protein, 538 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAAHPKQEPQEINFPDDLPGSNTAAPVQETLHGCQPVTQEDGKESRISVQERQ

SEQ ID NO: 365 - protein, 538 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTAEDGKESRISVQERQ

SEQ ID NO: 366 - protein, 600 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTAEDGKESRISVQERQKKVAKKPTNKAPHPKQEPQEINFPDDLPGSNTAAPVQETLHGCQPVTAEDGKESRISVQERQ

SEQ ID NO: 367 - protein, 538 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQAYAAPRDFAAYRSKKVAKKPTNKAPHPKQEPQEINFPDDLPGSNTAAPVQETLHGCQPVTQEDGKESRISVQERQ

SEQ ID NO: 368 - protein, 538 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDFMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 369 - protein, 497 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVKKVAKKPTNKAPHPKQEPQEINFPDDLPGSNTAAPVQETLHGCQPVTQEDGKESRISVQERQ

SEQ ID NO: 370 - protein, 543 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRFSVVKRGRKKLLYIFKQPFMRPVQTTQEEDGCSCRFPEEEEGGCEKKVAKKPTNKAPHPKQEPQEINFPDDLPGSNTAAPVQETLHGCQPVTQEDGKESRISVQERQ

SEQ ID NO: 371 - protein, 534 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRRDQRLPPDAHKPPGGGSFRTPIQEEQADAHSTLAKIKKVAKKPTNKAPHPKQEPQEINFPDDLPGSNTAAPVQETLHGCQPVTQEDGKESRISVQERQ

SEQ ID NO: 372 - protein, 613 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSNKKVAKKPTNKAPHPKQEPQEINFPDDLPGSNTAAPVQETLHGCQPVTQEDGKESRISVQERQ

SEQ ID NO: 373 - protein, 555 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVQLGLHIWQLRSQCMWPRETQLLLEVPPSTEDARSCQFPEEERGERSAEEKGRLGDLWVKKVAKKPTNKAPHPKQEPQEINFPDDLPGSNTAAPVQETLHGCQPVTQEDGKESRISVQERQ

SEQ ID NO: 374 - protein, 544 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVKLLMIIHDRREFAKFEKEKMNAKWDTGENPIYKSAVTTVVNPKYEGKKKVAKKPTNKAPHPKQEPQEINFPDDLPGSNTAAPVQETLHGCQPVTQEDGKESRISVQERQ

SEQ ID NO: 375 - protein, 572 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRRRGKTNHYQTTVEKKSLTIYAQVQKPGPLQKKLDSFPAQDPCTTIYVAATEPVPESVQETNSITVYASVTLPESKKVAKKPTNKAPHPKQEPQEINFPDDLPGSNTAAPVQETLHGCQPVTQEDGKESRISVQERQ

SEQ ID NO: 376 - protein, 421 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNKKVAKKPTNKAPHPKQEPQEINFPDDLPGSNTAAPVQETLHGCQPVTQEDGKESRISVQERQ

SEQ ID NO: 377 - protein, 467 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRFSVVKRGRKKLLYIFKQPFMRPVQTTQEEDGCSCRFPEEEEGGCEKKVAKKPTNKAPHPKQEPQEINFPDDLPGSNTAAPVQETLHGCQPVTQEDGKESRISVQERQ

SEQ ID NO: 378 - protein, 457 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRRDQRLPPDAHKPPGGGSFRTPIQEEQADAHSTLAKIKKVAKKPTNKAPHPKQEPQEINFPDDLPGSNTAAPVQETLHGCQPVTQEDGKSRISVQERQ

SEQ ID NO: 379 - protein, 537 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSNKKVAKKPTNKAPHPKQEPQEINFPDDLPGSNTAAPVQETLHGCQPVTQEDGKESRISVQERQ

SEQ ID NO: 380 - protein, 479 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNQLGLHIWQLRSQCMWPRETQLLLEVPPSTEDARSCQFPEEERGERSAEEKGRLGDLWVKKVAKKPTNKAPHPKQEPQEINFPDDLPGSNTAAPVQETLHGCQPVTQEDGKESRISVQERQ

SEQ ID NO: 381 - protein, 468 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNKLLMIIHDRREFAKFEKEKMNAKWDTGENPIYKSAVTTVVNPKYEGKKKVAKKPTNKAPHPKQEPQEINFPDDLPGSNTAAPVQETLHGCQPVTQEDGKESRISVQERQ

SEQ ID NO: 382 - protein, 496 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGFVPVFLPAKPTTTPAPRPPTPAPTIASQPLSLRPEACRPAAGGAVHTRGLDFACDIYIWAPLAGTCGVLLLSLVITLYCNHRNRRRGKTNHYQTTVEKKSLTIYAQVQKPGPLQKKLDSFPAQDPCTTIYVAATEPVPESVQETNSITVYASVTLPESKKVAKKPTNKAPHPKQEPQEINFPDDLPGSNTAAPVQETLHGCQPVTQEDGKESRISVQERQ

SEQ ID NO: 383 - protein, 636 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 384 - protein, 595 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVKKVAKKPTNKAPHPKQEPQEINFPDDLPGSNTAAPVQETLHGCQPVTQEDGKESRISVQERQ

SEQ ID NO: 385 - protein, 595 aa, Artificial Sequence; identical to SEQ ID NO: 384
  Synthetic polypeptide

SEQ ID NO: 386 - protein, 632 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRRDQRLPPDAHKPPGGGSFRTPIQEEQADAHSTLAKIKKVAKKPTNKAPHPKQEPQEINFPDDLPGSNTAAPVQETLHGCQPVTQEDGKESRISVQERQ

SEQ ID NO: 387 - protein, 711 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSNKKVAKKPTNKAPHPKQEPQEINFPDDLPGSNTAAPVQETLHGCQPVTQEDGKESRISVQERQ

SEQ ID NO: 388 - protein, 653 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVQLGLHIWQLRSQCMWPRETQLLLEVPPSTEDARSCQFPEEERGERSAEEKGRLGDLWVKKVAKKPTNKAPHPKQEPQEINFPDDLPGSNTAAPVQETLHGCQPVTQEDGKESRISVQERQ

SEQ ID NO: 389 - protein, 642 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVKLLMIIHDRREFAKFEKEKMNAKWDTGENPIYKSAVTTVVNPKYEGKKKVAKKPTNKAPHPKQEPQEINFPDDLPGSNTAAPVQETLHGCQPVTQEDGKESRISVQERQ

SEQ ID NO: 390 - protein, 670 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRRRGKTNHYQTTVEKKSLTIYAQVQKPGPLQKKLDSFPAQDPCTTIYVAATEPVPESVQETNSITVYASVTLPESKKVAKKPTNKAPHPKQEPQEINFPDDLPGSNTAAPVQETLHGCQPVTQEDGKESRISVQERQ

SEQ ID NO: 391 - protein, 658 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVAKKPTNKAPHPKQEPQEINFPDDLPGSNTAAPVQETLHGCQPVTQEDGKESRISVQERQKKVAKKPTNKAPHPKQEPQEINFPDDLPGSNTAAPVQETLHGCQPVTQEDGKESRISVQERQKKVA

SEQ ID NO: 392 - protein, 595 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVKKVAKKPTNKAAHPKQEPQEINFPDDLPGSNTAAPVQETLHGCQPVTQEDGKESRISVQERQ

SEQ ID NO: 393 - protein, 554 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 394 - protein, 513 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHCPSPLFPGPSKPFWVLVVVGGVLACYSLLVTVAFIIFWVKKVAKKPTNKAPHPKQEPQEINFPDDLPGSNTAAPVQETLHGCQPVTQEDGKESRISVQERQ

SEQ ID NO: 395 - protein, 526 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 396 - protein, 485 aa, Artificial Sequence
  Synthetic polypeptide
MGVLLTQRTLLSLVLALLFPSMASMQVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAGSGGSGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPFWVLVVVGGVLACYSLLVTVAFIIFWVKKVAKKPTNKAPHPKQEPQEINFPDDLPGSNTAAPVQETLHGCQPVTQEDGKESRISVQERQ

SEQ ID NO: 397 - protein, 540 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 398 - protein, 499 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVKKVAKKPTNKAPHPKQEPQEINFPDDLPGSNTAAPVQETLHGCQPVTQEDGKESRISVQERQ

SEQ ID NO: 399 - protein, 545 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRFSVVKRGRKKLLYIFKQPFMRPVQTTQEEDGCSCRFPEEEEGGCEKKVAKKPTNKAPHPKQEPQEINFPDDLPGSNTAAPVQETLHGCQPVTQEDGKESRISVQERQ

SEQ ID NO: 400 - protein, 536 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRRDQRLPPDAHKPPGGGSFRTPIQEEQADAHSTLAKIKKVAKKPTNKAPHPKQEPQEINFPDDLPGSNTAAPVQETLHGCQPVTQEDGKESRISVQERQ

SEQ ID NO: 401 - protein, 615 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSNKKVAKKPTNKAPHPKQEPQEINFPDDLPGSNTAAPVQETLHGCQPVTQEDGKESRISVQERQ

SEQ ID NO: 402 - protein, 557 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVQLGLHIWQLRSQCMWPRETQLLLEVPPSTEDARSCQFPEEERGERSAEEKGRLGDLWVKKVAKKPTNKAPHPKQEPQEINFPDDLPGSNTAAPVQETLHGCQPVTQEDGKESRISVQERQ

SEQ ID NO: 403 - protein, 546 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVKLLMIIHDRREFAKFEKEKMNAKWDTGENPIYKSAVTTVVNPKYEGKKKVAKKPTNKAPHPKQEPQEINFPDDLPGSNTAAPVQETLHGCQPVTQEDGKESRISVQERQ

SEQ ID NO: 404 - protein, 574 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRRRGKTNHYQTTVEKKSLTIYAQVQKPGPLQKKLDSFPAQDPCTTIYVAATEPVPESVQETNSITVYASVTLPESKKVAKKPTNKAPHPKQEPQEINFPDDLPGSNTAAPVQETLHGCQPVTQEDGKESRISVQERQ

SEQ ID NO: 405 - protein, 464 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 406 - protein, 423 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNKKVAKKPTNKAPHPKQEPQEINFPDDLPGSNTAAPVQETLHGCQPVTQEDGKESRISVQERQ

SEQ ID NO: 407 - protein, 469 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRFSVVKRGRKKLLYIFKQPFMRPVQTTQEEDGCSCRFPEEEEGGCEKKVAKKPTNKAPHPKQEPQEINFPDDLPGSNTAAPVQETLHGCQPVTQEDGKESRISVQERQ

SEQ ID NO: 408 - protein, 459 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRRDQRLPPDAHKPPGGGSFRTPIQEEQADAHSTLAKIKKVAKKPTNKAPHPKQEPQEINFPDDLPGSNTAAPVQETLHGCQPVTQEDGKSRISVQERQ

SEQ ID NO: 409 - protein, 539 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSNKKVAKKPTNKAPHPKQEPQEINFPDDLPGSNTAAPVQETLHGCQPVTQEDGKESRISVQERQ

SEQ ID NO: 410 - protein, 481 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNQLGLHIWQLRSQCMWPRETQLLLEVPPSTEDARSCQFPEEERGERSAEEKGRLGDLWVKKVAKKPTNKAPHPKQEPQEINFPDDLPGSNTAAPVQETLHGCQPVTQEDGKESRISVQERQ

SEQ ID NO: 411 - protein, 470 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNKLLMIIHDRREFAKFEKEKMNAKWDTGENPIYKSAVTTVVNPKYEGKKKVAKKPTNKAPHPKQEPQEINFPDDLPGSNTAAPVQETLHGCQPVTQEDGKESRISVQERQ

SEQ ID NO: 412 - protein, 498 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGFVPVFLPAKPTTTPAPRPPTPAPTIASQPLSLRPEACRPAAGGAVHTRGLDFACDIYIWAPLAGTCGVLLLSLVITLYCNHRNRRRGKTNHYQTTVEKKSLTIYAQVQKPGPLQKKLDSFPAQDPCTTIYVAATEPVPESVQETNSITVYASVTLPESKKVAKKPTNKAPHPKQEPQEINFPDDLPGSNTAAPVQETLHGCQPVTQEDGKESRISVQERQ

SEQ ID NO: 413 - protein, 638 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 414 - protein, 597 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVKKVAKKPTNKAPHPKQEPQEINFPDDLPGSNTAAPVQETLHGCQPVTQEDGKESRISVQERQ

SEQ ID NO: 415 - protein, 597 aa, Artificial Sequence; identical to SEQ ID NO: 414
  Synthetic polypeptide

SEQ ID NO: 416 - protein, 634 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRRDQRLPPDAHKPPGGGSFRTPIQEEQADAHSTLAKIKKVAKKPTNKAPHPKQEPQEINFPDDLPGSNTAAPVQETLHGCQPVTQEDGKESRISVQERQ

SEQ ID NO: 417 - protein, 713 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSNKKVAKKPTNKAPHPKQEPQEINFPDDLPGSNTAAPVQETLHGCQPVTQEDGKESRISVQERQ

SEQ ID NO: 418 - protein, 655 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVQLGLHIWQLRSQCMWPRETQLLLEVPPSTEDARSCQFPEEERGERSAEEKGRLGDLWVKKVAKKPTNKAPHPKQEPQEINFPDDLPGSNTAAPVQETLHGCQPVTQEDGKESRISVQERQ

SEQ ID NO: 419 - protein, 644 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVKLLMIIHDRREFAKFEKEKMNAKWDTGENPIYKSAVTTVVNPKYEGKKKVAKKPTNKAPHPKQEPQEINFPDDLPGSNTAAPVQETLHGCQPVTQEDGKESRISVQERQ

SEQ ID NO: 420 - protein, 672 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRRRGKTNHYQTTVEKKSLTIYAQVQKPGPLQKKLDSFPAQDPCTTIYVAATEPVPESVQETNSITVYASVTLPESKKVAKKPTNKAPHPKQEPQEINFPDDLPGSNTAAPVQETLHGCQPVTQEDGKESRISVQERQ

SEQ ID NO: 421 - protein, 660 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVAKKPTNKAPHPKQEPQEINFPDDLPGSNTAAPVQETLHGCQPVTQEDGKESRISVQERQKKVAKKPTNKAPHPKQEPQEINFPDDLPGSNTAAPVQETLHGCQPVTQEDGKESRISVQERQKKVA

SEQ ID NO: 422 - protein, 597 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVKKVAKKPTNKAAHPKQEPQEINFPDDLPGSNTAAPVQETLHGCQPVTQEDGKESRISVQERQ

SEQ ID NO: 423 - protein, 297 aa, Artificial Sequence
  Synthetic polypeptide
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 424 - protein, 260 aa, Artificial Sequence
  Synthetic polypeptide
MQIPQAPWPVVWAVLQLGWRPGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHCPSPLFPGPSKPFWVLVVVGGVLACYSLLVTVAFIIFWVKKVAKKPTNKAPHPKQEPQEINFPDDLPGSNTAAPVQETLHGCQPVTQEDGKESRISVQERQ

SEQ ID NO: 425 - protein, 271 aa, Artificial Sequence
  Synthetic polypeptide
MRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 426 - protein, 230 aa, Artificial Sequence
  Synthetic polypeptide
MRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPFWVLVVVGGVLACYSLLVTVAFIIFWVKKVAKKPTNKAPHPKQEPQEINFPDDLPGSNTAAPVQETLHGCQPVTQEDGKESRISVQERQ

SEQ ID NO: 427 - protein, 556 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 428 - protein, 515 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHCPSPLFPGPSKPFWVLVVVGGVLACYSLLVTVAFIIFWVKKVAKKPTNKAPHPKQEPQEINFPDDLPGSNTAAPVQETLHGCQPVTQEDGKESRISVQERQ

SEQ ID NO: 429 - protein, 528 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 430 - protein, 487 aa, Artificial Sequence
  Synthetic polypeptide
MGVLLTQRTLLSLVLALLFPSMASMQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKAAAGSGGSGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPFWVLVVVGGVLACYSLLVTVAFIIFWVKKVAKKPTNKAPHPKQEPQEINFPDDLPGSNTAAPVQETLHGCQPVTQEDGKESRISVQERQ

SEQ ID NO: 431 - protein, 15 aa, Artificial Sequence
  Synthetic polypeptide
GGGGSGGGGSGGGGS

SEQ ID NO: 432 - protein, 165 aa, Artificial Sequence
  Synthetic polypeptide
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKR

SEQ ID NO: 433 - protein, 248 aa, Artificial Sequence
  Synthetic polypeptide
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRFSVVKRGRKKLLYIFKQPFMRPVQTTQEEDGCSCRFPEEEEGGCE

SEQ ID NO: 434 - protein, 239 aa, Artificial Sequence
  Synthetic polypeptide
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRRDQRLPPDAHKPPGGGSFRTPIQEEQADAHSTLAKI

SEQ ID NO: 435 - protein, 318 aa, Artificial Sequence
  Synthetic polypeptide
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 436 - protein, 249 aa, Artificial Sequence
  Synthetic polypeptide
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKLLMIIHDRREFAKFEKEKMNAKWDTGENPIYKSAVTTVVNPKYEGK

SEQ ID NO: 437 - protein, 260 aa, Artificial Sequence
  Synthetic polypeptide
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSQLGLHIWQLRSQCMWPRETQLLLEVPPSTEDARSCQFPEEERGERSAEEKGRLGDLWV

SEQ ID NO: 438 - protein, 288 aa, Artificial Sequence
  Synthetic polypeptide
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 439 - protein, 264 aa, Artificial Sequence
  Synthetic polypeptide
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKKVAKKPTNKAPHPKQEPQEINFPDDLPGSNTAAPVQETLHGCQPVTQEDGKESRISVQERQ

SEQ ID NO: 440 - protein, 277 aa, Artificial Sequence
  Synthetic polypeptide
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRRRGKTNHYQTTVEKKSLTIYAQVQKPGPLQKKLDSFPAQDPCTTIYVAATEPVPESVQETNSITVYASVTLPES

SEQ ID NO: 441 - protein, 380 aa, Artificial Sequence
  Synthetic polypeptide
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSNKKVAKKPTNKAPHPKQEPQEINFPDDLPGSNTAAPVQETLHGCQPVTQEDGKESRISVQERQ

SEQ ID NO: 442 - protein, 107 aa, Artificial Sequence
  Synthetic polypeptide
IEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 443 - protein, 8 aa, Artificial Sequence
  Synthetic polypeptide
PTNKAPHP

SEQ ID NO: 444 - protein, 7 aa, Artificial Sequence
  Synthetic polypeptide
PTNKAPH

SEQ ID NO: 445 - protein, 5 aa, Artificial Sequence
  Synthetic polypeptide
PKQET

SEQ ID NO: 446 - protein, 5 aa, Artificial Sequence
  Synthetic polypeptide
PVQET

SEQ ID NO: 447 - protein, 5 aa, Artificial Sequence
  Synthetic polypeptide
SVQET

SEQ ID NO: 448 - protein, 8 aa, Artificial Sequence
  Synthetic polypeptide
QEPQEINF

SEQ ID NO: 449 - protein, 8 aa, Artificial Sequence
  Synthetic polypeptide
DYKDDDDK

SEQ ID NO: 450 - protein, 11 aa, Artificial Sequence
  Synthetic polypeptide
PFSKEECAFRS

SEQ ID NO: 451 - protein, 11 aa, Artificial Sequence
  Synthetic polypeptide
AAPVQETLHGC

SEQ ID NO: 452 - protein, 11 aa, Artificial Sequence
  Synthetic polypeptide
MLSVEEEGKED

SEQ ID NO: 453 - protein, 11 aa, Artificial Sequence
  Synthetic polypeptide
TIPIQEDYRKP

SEQ ID NO: 454 - protein, 11 aa, Artificial Sequence
  Synthetic polypeptide
STPHQEDGKAW

SEQ ID NO: 455 - protein, 11 aa, Artificial Sequence
  Synthetic polypeptide
TVAVEETIPST

SEQ ID NO: 456 - protein, 11 aa, Artificial Sequence
  Synthetic polypeptide
RTPIQEEQADA

SEQ ID NO: 457 - protein, 11 aa, Artificial Sequence
  Synthetic polypeptide
TGAAQEEDACS

SEQ ID NO: 458 - protein, 11 aa, Artificial Sequence
  Synthetic polypeptide
RCPQEEEGGGG

SEQ ID NO: 459 - protein, 11 aa, Artificial Sequence
  Synthetic polypeptide
VQTTQEEDGCS

SEQ ID NO: 460 - protein, 11 aa, Artificial Sequence
  Synthetic polypeptide
RFPEEEEGGCE

SEQ ID NO: 461 - protein, 11 aa, Artificial Sequence
  Synthetic polypeptide
RTPVQESGYPD

SEQ ID NO: 462 - protein, 11 aa, Artificial Sequence
  Synthetic polypeptide
RPPVQETGGGG

SEQ ID NO: 463 - protein, 11 aa, Artificial Sequence
  Synthetic polypeptide
HPPVQETGGGG

SEQ ID NO: 464 - protein, 11 aa, Artificial Sequence
  Synthetic polypeptide
HPPVQETGEGG

SEQ ID NO: 465 - protein, 11 aa, Artificial Sequence
  Synthetic polypeptide
HPPIQETGNGG

SEQ ID NO: 466 - protein, 11 aa, Artificial Sequence
  Synthetic polypeptide
ALSSQEAEEVE

SEQ ID NO: 467 - protein, 11 aa, Artificial Sequence
  Synthetic polypeptide
SVPIQCTDKTD

SEQ ID NO: 468 - protein, 11 aa, Artificial Sequence
  Synthetic polypeptide
PHPQQATDDSS

SEQ ID NO: 469 - protein, 11 aa, Artificial Sequence
  Synthetic polypeptide
PYPIQATDGGN

SEQ ID NO: 470 - protein, 11 aa, Artificial Sequence
  Synthetic polypeptide
PHPIQATDGAN

SEQ ID NO: 471 - protein, 11 aa, Artificial Sequence
  Synthetic polypeptide
PYPVQASDGGD

SEQ ID NO: 472 - protein, 8 aa, Artificial Sequence
  VARIANT (5)...(5): Xaa can be any amino acid
  Synthetic polypeptide
PSATXQEE

SEQ ID NO: 473 - protein, 4 aa, Artificial Sequence
  Synthetic polypeptide
PVQE

SEQ ID NO: 474 - protein, 38 aa, Artificial Sequence
  Synthetic polypeptide
KKVAKKPTNKAPHPKQEPQEINFPDDLPGSNTAAPVQE

SEQ ID NO: 475 - protein, 24 aa, Artificial Sequence
  Synthetic polypeptide
TLHGCQPVTQEDGKESRISVQERQ

SEQ ID NO: 476 - protein, 38 aa, Artificial Sequence
  Synthetic polypeptide
KKVAKKPTNKAPHPKQEPQEINFPDDLPGSNTAATQEE

SEQ ID NO: 477 - protein, 24 aa, Artificial Sequence
  Synthetic polypeptide
TLHGCQPVTQEDGKESRISVQERQ

SEQ ID NO: 478 - protein, 38 aa, Artificial Sequence
  Synthetic polypeptide
KKVAKKPTNKAPHPKQEPQEINFPDDLPGSNTAASKEE

SEQ ID NO: 479 - protein, 24 aa, Artificial Sequence
  Synthetic polypeptide
TLHGCQPVTQEDGKESRISVQERQ

SEQ ID NO: 480 - protein, 6 aa, Artificial Sequence
  Synthetic polypeptide
PQEINF

SEQ ID NO: 481 - protein, 6 aa, Artificial Sequence
  Synthetic polypeptide
PQEIDF

SEQ ID NO: 482 - protein, 6 aa, Artificial Sequence
  Synthetic polypeptide
PPELRF

SEQ ID NO: 483 - protein, 6 aa, Artificial Sequence
  Synthetic polypeptide
PEEMSW

SEQ ID NO: 484 - protein, 6 aa, Artificial Sequence
  Synthetic polypeptide
PQENSY

SEQ ID NO: 485 - protein, 6 aa, Artificial Sequence
  Synthetic polypeptide
PVESDE

SEQ ID NO: 486 - protein, 6 aa, Artificial Sequence
  Synthetic polypeptide
PEESDE

SEQ ID NO: 487 - protein, 6 aa, Artificial Sequence
  Synthetic polypeptide
PEETDE

SEQ ID NO: 488 - protein, 6 aa, Artificial Sequence
  Synthetic polypeptide
PTENGE

SEQ ID NO: 489 - protein, 6 aa, Artificial Sequence
  Synthetic polypeptide
PVEDDE

SEQ ID NO: 490 - protein, 6 aa, Artificial Sequence
  Synthetic polypeptide
PPENYE

SEQ ID NO: 491 - protein, 6 aa, Artificial Sequence
  Synthetic polypeptide
PSELRF

SEQ ID NO: 492 - protein, 6 aa, Artificial Sequence
  VARIANT (2)...(2): Xaa can be any amino acid
  VARIANT (4)...(5): Xaa can be any amino acid
  VARIANT (6)...(6): Xaa can be any acidic or aromatic amino acid
  Synthetic polypeptide
PXEXXX

SEQ ID NO: 493 - protein, 38 aa, Artificial Sequence; identical to SEQ ID NO: 474
  Synthetic polypeptide

SEQ ID NO: 494 - protein, 24 aa, Artificial Sequence
  Synthetic polypeptide
TLHGCQPVTQEDGKESRISVQERQ

SEQ ID NO: 495 - protein, 38 aa, Artificial Sequence
  Synthetic polypeptide
KKVAKKPTNKAPHPKQEPEEMSWPDDLPGSNTAAPVQE

SEQ ID NO: 496 - protein, 24 aa, Artificial Sequence
  Synthetic polypeptide
TLHGCQPVTQEDGKESRISVQERQ

SEQ ID NO: 497 - protein, 38 aa, Artificial Sequence; identical to SEQ ID NO: 474
  Synthetic polypeptide

SEQ ID NO: 498 - protein, 24 aa, Artificial Sequence
  Synthetic polypeptide
TLHGCQPVTQEDGKESRISVQERQ

SEQ ID NO: 499 - protein, 62 aa, Artificial Sequence
  Synthetic polypeptide
  VARIANT (19)...(19): Xaa can be any amino acid
  VARIANT (21)...(22): Xaa can be any amino acid
  VARIANT (23)...(23): Xaa can be any acidic or aromatic amino acid
KKVAKKPTNKAPHPKQEPXEXXXPDDLPGSNTAAPVQETLHGCQPVTQEDGKESRISVQERQ

SEQ ID NO: 500 - protein, 62 aa, Artificial Sequence
  Synthetic polypeptide
  VARIANT (35)...(35): Xaa can be P, S, A, or T
  VARIANT (36)...(36): Xaa can be any amino acid
  VARIANT (37)...(37): Xaa can be Q or E
KKVAKKPTNKAPHPKQEPQEINFPDDLPGSNTAAXXXETLHGCQPVTQEDGKESRISVQERQ

SEQ ID NO: 501 - protein, 38 aa, Artificial Sequence; identical to SEQ ID NO: 474
  Synthetic polypeptide

SEQ ID NO: 502 - protein, 24 aa, Artificial Sequence
  Synthetic polypeptide
  VARIANT (19)...(19): Xaa can be P, S, A, or T
  VARIANT (20)...(20): Xaa can be any amino acid
  VARIANT (21)...(21): Xaa can be Q or E
TLHGCQPVTQEDGKESRIXXXERQ

SEQ ID NO: 503 - protein, 62 aa, Artificial Sequence
  Synthetic polypeptide
  VARIANT (19)...(19): Xaa can be any amino acid
  VARIANT (21)...(22): Xaa can be any amino acid
  VARIANT (23)...(23): Xaa can be any acidic or aromatic amino acid
  VARIANT (35)...(35): Xaa can be P, S, A, or T
  VARIANT (36)...(36): Xaa can be any amino acid
  VARIANT (37)...(37): Xaa can be Q or E
KKVAKKPTNKAPHPKQEPXEXXXPDDLPGSNTAAXXXETLHGCQPVTQEDGKESRISVQERQ

SEQ ID NO: 504 - protein, 62 aa, Artificial Sequence
  Synthetic polypeptide
  VARIANT (35)...(35): Xaa can be P, S, A, or T
  VARIANT (36)...(36): Xaa can be any amino acid
  VARIANT (37)...(37): Xaa can be Q or E
  VARIANT (57)...(57): Xaa can be P, S, A, or T
  VARIANT (58)...(58): Xaa can be any amino acid
  VARIANT (59)...(59): Xaa can be Q or E
KKVAKKPTNKAPHPKQEPQEINFPDDLPGSNTAAXXXETLHGCQPVTQEDGKESRIXXXERQ

SEQ ID NO: 505 - protein, 38 aa, Artificial Sequence
  Synthetic polypeptide
  VARIANT (19)...(19): Xaa can be any amino acid
  VARIANT (21)...(22): Xaa can be any amino acid
  VARIANT (23)...(23): Xaa can be any acidic or aromatic amino acid
KKVAKKPTNKAPHPKQEPXEXXXPDDLPGSNTAAPVQE

SEQ ID NO: 506 - protein, 98 aa, Artificial Sequence
  Synthetic polypeptide
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEV

SEQ ID NO: 507 - protein, 21 aa, Artificial Sequence
  Synthetic polypeptide
MRWCLLLIWAQGLRQAPLASG

SEQ ID NO: 508 - protein, 240 aa, Artificial Sequence; identical to SEQ ID NO: 186
  Synthetic polypeptide

SEQ ID NO: 509 - protein, 236 aa, Artificial Sequence; identical to SEQ ID NO: 187
  Synthetic polypeptide

SEQ ID NO: 510 - protein, 241 aa, Artificial Sequence; identical to SEQ ID NO: 188
  Synthetic polypeptide

SEQ ID NO: 511 - protein, 241 aa, Artificial Sequence; identical to SEQ ID NO: 189
  Synthetic polypeptide

SEQ ID NO: 512 - protein, 249 aa, Artificial Sequence; identical to SEQ ID NO: 190
  Synthetic polypeptide

SEQ ID NO: 513 - protein, 254 aa, Artificial Sequence; identical to SEQ ID NO: 191
  Synthetic polypeptide

SEQ ID NO: 514 - protein, 462 aa, Artificial Sequence; identical to SEQ ID NO: 66
  Synthetic polypeptide

SEQ ID NO: 515 - protein, 180 aa, Artificial Sequence
  Synthetic polypeptide
GEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 516 - protein, 4 aa, Artificial Sequence
  Synthetic polypeptide
PKQE

SEQ ID NO: 517 - protein, 4 aa, Artificial Sequence
  Synthetic polypeptide
PVQE

SEQ ID NO: 518 - protein, 4 aa, Artificial Sequence
  Synthetic polypeptide
SVQE

SEQ ID NO: 519 - protein, 9 aa, Artificial Sequence
  Synthetic polypeptide
QEPQEINFP

SEQ ID NO: 520 - protein, 7 aa, Artificial Sequence
  Synthetic polypeptide
KKPTNKA

SEQ ID NO: 521 - protein, 7 aa, Artificial Sequence
  Synthetic polypeptide
SRISVQE

SEQ ID NO: 522 - protein, 132 aa, Artificial Sequence
  Synthetic polypeptide
ILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKP

What is claimed is:

1. A chimeric costimulatory antigen receptor (CoStAR) which comprises:
   an extracellular binding domain that binds to carcinoembryonic antigen (CEA);
   operatively linked to ICOS, wherein ICOS comprises the amino acid sequence of SEQ ID NO: 515; and
   a CD40 signaling domain, wherein the CD40 signaling domain comprises the amino acid sequence of SEQ ID NO: 32,
   wherein ICOS is linked to the CD40 signaling domain, and wherein the extracellular binding domain comprises:
   a HCDR1 that is an HCDR1 in SEQ ID NO: 12;
   a HCDR2 that is an HCDR2 in SEQ ID NO: 12;
   a HCDR3 that is an HCDR3 in SEQ ID NO: 12;
   a LCDR1 that is an LCDR1 in SEQ ID NO: 12;
   a LCDR2 that is an LCDR2 in SEQ ID NO: 12; and
   a LCDR3 that is an HCDR3 in SEQ ID NO: 12.

2. The CoStAR of claim 1, wherein the extracellular binding domain is operatively linked to ICOS by a linker and/or a spacer.

3. The CoStAR of claim 2, wherein the linker comprises from about 5 to about 20 amino acids.

4. The CoStAR of claim 2, wherein the linker or spacer comprises from about 10 to about 250 amino acids.

5. The CoStAR of claim 1, wherein a heavy chain variable region of the CoStAR is linked to a light chain variable region by a first linker.

6. The CoSTaR of claim 5, wherein the first linker comprises the sequence of SEQ ID NO: 431.

7. The CoSTaR of claim 6, wherein the binding domain is linked to the domain of ICOS by a second linker.

8. The CoSTaR of claim 7, wherein the second linker comprises the amino acid sequence of SEQ ID NO: 18.

9. A fusion protein, wherein the fusion protein comprises:
   a first sequence, wherein the first sequence comprises:
   a HCDR1 that is an HCDR1 in SEQ ID NO: 12;
   a HCDR2 that is an HCDR2 in SEQ ID NO: 12;
   a HCDR3 that is an HCDR3 in SEQ ID NO: 12;
   a LCDR1 that is an LCDR1 in SEQ ID NO: 12;
   a LCDR2 that is an LCDR2 in SEQ ID NO: 12;
   a LCDR3 that is an HCDR3 in SEQ ID NO: 12,
   second sequence that comprises the amino acid sequence of SEQ ID NO: 515; and
   a third sequence that comprises the amino acid sequence of ID NO: 32, wherein the first sequence is linked to the second sequence, and wherein the second sequence is linked to the third sequence.

10. The fusion protein of claim 9, wherein the fusion protein further comprises a signal peptide sequence that is the amino acid sequence of SEQ ID NO: 1.

11. The fusion protein of claim 10, wherein the fusion protein further comprises a linker sequence that is the amino acid sequence of SEQ ID NO: 18.

12. A fusion protein, the fusion protein comprising amino acids numbered 26 to 517 of SEQ ID NO: 348.

13. The fusion protein of claim 12, wherein the fusion protein consists essentially of amino acids 26 to 517 of SEQ ID NO: 348.

14. A method of cell therapy comprising:
   a) identifying a subject, wherein the subject has cancer that expresses CEA; and
   b) administering a therapeutically effective amount of a TIL expressing a fusion protein to said subject, wherein the fusion protein comprises amino acids numbered 26 to 517 of SEQ ID NO: 348.

\* \* \* \* \*

UNITED STATES PATENT AND TRADEMARK OFFICE
CERTIFICATE OF CORRECTION

PATENT NO. : 11,945,876 B2
APPLICATION NO. : 17/807109
DATED : April 2, 2024
INVENTOR(S) : John Bridgeman et al.

It is certified that error appears in the above-identified patent and that said Letters Patent is hereby corrected as shown below:

On the Title Page

Page 4, Column 1 item (56) (Other Publications), Line 45, delete "Lumphocytic" and insert -- Lymphocytic --.

In the Specification

Column 4, Line 22, delete "orb)" and insert -- or b) --.

Column 6, Line 41, delete "of of" and insert -- of --.

Column 9, Line 46, delete "*p<0.05" and insert -- *p<0.05. --.

Column 12, Line 5, delete "in in" and insert -- in --.

Column 12, Line 33, delete "MOVI9" and insert -- MOV19 --.

Column 13, Line 50, delete "IFN'" and insert -- IFNγ --.

Column 15, Line 44, delete "co-stumulatory" and insert -- co-stimulatory --.

Column 15, Line 52, delete "*p<0.05" and insert -- *p<0.05. --.

Column 18, Line 56, delete "antibody" and insert -- antibody. --.

Column 21, Line 11, delete "MNS," and insert -- MN5, --.

Column 22, Line 47, delete "ore" and insert -- or --.

Column 22, Line 48, delete "preceeding" and insert -- preceding --.

Signed and Sealed this
Twentieth Day of August, 2024

*Katherine Kelly Vidal*
Katherine Kelly Vidal
*Director of the United States Patent and Trademark Office*

CERTIFICATE OF CORRECTION (continued)
U.S. Pat. No. 11,945,876 B2

Column 23, Line 27, delete "the the" and insert -- the --.

Column 27 (Table 1), Line 23 (approx.), delete "hLTpR" and insert -- hLTβR --.

Column 29 (Table 3), Line 7 (approx.), delete "Pl" and insert -- P1 --.

Column 31, Line 43, delete "activiation" and insert -- activation --.

Column 31, Line 44, delete "4-*IBB*" and insert -- 4-1*BB* --.

Column 45 (Table 6), Line 21, delete "Norleucinne;" and insert -- Norleucine; --.

Column 45 (Table 6), Line 21, delete "He" and insert -- Ile --.

Column 45, Line 35 (approx.), delete "aomatic:" and insert -- aromatic: --.

Column 57, Line 20, delete "VII" and insert -- VH --.

Column 61, Line 64-65, delete "craniopharyogioma," and insert -- craniopharyngioma, --.

Column 61, Line 66, delete "menangioma," and insert -- meningioma, --.

Column 63, Line 17 (approx.), delete "198" and insert -- 198. --.

Column 63, Line 47, delete "alemtuzamab," and insert -- alemtuzumab, --.

Column 64, Line 65, delete "may may" and insert -- may --.

Column 66, Line 3, delete "imprecisesly" and insert -- imprecisely --.

Column 200, Line 11, delete "CD3" and insert -- CD3ζ --.

Column 200, Line 19, delete "IgGK." and insert -- IgGκ. --.

Column 204, Line 55, delete "an an" and insert -- an --.

Column 205, Line 7, delete "polybrene" and insert -- μg/ml polybrene --.

Column 207, Line 12, delete "(See FIG. 6)" and insert -- (See FIG. 6). --.

Column 207, Line 63, delete "TCRO" and insert -- TCRβ --.

Column 209, Line 24-25, delete "MEP-113" and insert -- MEP-1β --.

Column 234, Line 42, delete "of of" and insert -- of --.

CERTIFICATE OF CORRECTION (continued)
U.S. Pat. No. 11,945,876 B2

Column 239, Line 26, delete "in in" and insert -- in --.

Column 241, Line 14 (approx.), delete "TNFφ." and insert -- TNFα, --.

Column 241, Line 60 (approx.), delete "FIG." and insert -- FIGS. --.

Column 243, Line 8, delete "1:20)" and insert -- 1:20). --.

Column 243, Line 37, delete "and and" and insert -- and --.

Column 244, Line 10 (approx.), delete "1904" and insert -- 190 µL --.

Column 246, Line 4, delete "the to" and insert -- to --.

In the Claims

Column 248, Line 26, Claim 9, delete "of" and insert -- of SEQ --.